(12) United States Patent
Carvalho et al.

(10) Patent No.: US 11,440,960 B2
(45) Date of Patent: Sep. 13, 2022

(54) TIGIT ANTIBODIES, ENCODING NUCLEIC ACIDS AND METHODS OF USING SAID ANTIBODIES IN VIVO

(71) Applicant: Kymab Limited, Cambridge (GB)

(72) Inventors: Joana de Abreu Carvalho, Cambridge (GB); Rachael Jane Kimber, Cambridge (GB); Jamie Ian Campbell, Cambridge (GB); Nikole Sandy, Cambridge (GB); Cassandra Van Krinks, Cambridge (GB); Stephen John Arkinstall, Cambridge (GB); Volker Germaschewski, Cambridge (GB); Ian Kirby, Cambridge (GB); Miha Kosmac, Cambridge (GB); Thomas Gallagher, Cambridge (GB); Matthew John McCourt, Cambridge (GB); Richard Charles Alfred Sainson, Cambridge (GB); Mohammed Hanif Ali, Cambridge (GB); E-Chiang Lee, Cambridge (GB); Stephen Douglas Gillies, Carlisle, MA (US)

(73) Assignee: KYMAB LIMITED, Cambridge (GB)

( * ) Notice: Subject to any disclaimer, the term of this patent is extended or adjusted under 35 U.S.C. 154(b) by 207 days.

(21) Appl. No.: 16/623,929

(22) PCT Filed: Jun. 20, 2018

(86) PCT No.: PCT/GB2018/051714
§ 371 (c)(1),
(2) Date: Dec. 18, 2019

(87) PCT Pub. No.: WO2018/234793
PCT Pub. Date: Dec. 27, 2018

(65) Prior Publication Data
US 2020/0131267 A1 Apr. 30, 2020

(30) Foreign Application Priority Data
Jun. 20, 2017 (GB) ..................................... 1709808

(51) Int. Cl.
*A61P 35/00* (2006.01)
*A61K 39/395* (2006.01)
*A61K 39/00* (2006.01)
*C07K 16/28* (2006.01)

(52) U.S. Cl.
CPC ...... *C07K 16/2803* (2013.01); *A61K 39/3955* (2013.01); *A61P 35/00* (2018.01); *C07K 16/2827* (2013.01); *A61K 2039/505* (2013.01); *C07K 2317/21* (2013.01); *C07K 2317/31* (2013.01); *C07K 2317/565* (2013.01); *C07K 2317/76* (2013.01); *C07K 2317/92* (2013.01)

(58) Field of Classification Search
CPC ............ C07K 16/2803; C07K 16/2827; C07K 2317/21; C07K 2317/31; C07K 2317/565; C07K 2317/76; C07K 2317/92; A61K 39/3955; A61K 2039/505; A61P 35/00
See application file for complete search history.

(56) References Cited

U.S. PATENT DOCUMENTS

| | | | |
|---|---|---|---|
| 5,869,046 A | 2/1999 | Presta et al. | |
| 6,121,022 A | 9/2000 | Presta et al. | |
| 6,803,039 B2 | 10/2004 | Tsuji et al. | |
| 7,030,225 B1 | 4/2006 | Tamatani et al. | |
| 7,045,615 B2 | 5/2006 | Tamatani et al. | |
| 7,125,551 B2 | 10/2006 | Kroczek | |
| 7,132,099 B2 | 11/2006 | Kroczek | |
| 7,166,283 B2 | 1/2007 | Tsuji et al. | |
| 7,196,175 B2 | 3/2007 | Tamatani et al. | |
| 7,226,909 B2 | 6/2007 | Tamatani et al. | |
| 7,259,247 B1 | 8/2007 | Kroczek | |
| 7,279,560 B2 | 10/2007 | Tamatani et al. | |
| 7,306,800 B2 | 12/2007 | Kroczek | |
| 7,438,905 B2 | 10/2008 | Suzuki et al. | |
| 7,465,445 B2 | 12/2008 | Tezuka et al. | |
| 7,722,872 B2 | 5/2010 | Kroczek | |
| 7,794,710 B2 | 9/2010 | Chen et al. | |
| 7,892,540 B2 | 2/2011 | Chen et al. | |
| 7,932,358 B2 | 4/2011 | Tamatani et al. | |
| 7,988,965 B2 | 8/2011 | Tsuji et al. | |
| 7,998,478 B2 | 8/2011 | Tezuka et al. | |
| 8,168,179 B2 | 5/2012 | Honjo et al. | |
| 8,318,905 B2 | 11/2012 | Kroczek | |
| 8,389,690 B2 | 3/2013 | Tamatani et al. | |
| 8,840,889 B2 | 9/2014 | Chen | |
| 8,916,155 B2 | 12/2014 | Kroczek | |
| 9,102,725 B2 | 8/2015 | Korman et al. | |
| 9,376,493 B2 | 6/2016 | Faget et al. | |
| 9,567,399 B1 | 2/2017 | Campbell et al. | |
| 9,617,338 B1 | 4/2017 | Campbell et al. | |

(Continued)

FOREIGN PATENT DOCUMENTS

| | | |
|---|---|---|
| EP | 0984023 A1 | 3/2000 |
| EP | 1125585 A1 | 8/2001 |
| EP | 1158004 A2 | 11/2001 |
| EP | 1374901 A1 | 1/2004 |
| EP | 1502920 A2 | 2/2005 |

(Continued)

OTHER PUBLICATIONS

Paul, WE (1993) Fundamental Immunology, 3rd ed. Raven Press, NY, Chap. 9, pp. 292-295.*

(Continued)

*Primary Examiner* — Robert S Landsman
(74) *Attorney, Agent, or Firm* — Lathrop GPM LLP; James H. Velema, Esq.

(57) ABSTRACT

The present invention relates to antibodies specific for one or more antigens, bispecific antibodies containing one or more domains with specificity to the target(s), and to immunocytokines. The present invention also provides methods of treatment, uses and pharmaceutical compositions comprising the antibodies, bispecific antibodies and immunocytokines.

14 Claims, 70 Drawing Sheets

Specification includes a Sequence Listing.

(56) References Cited

U.S. PATENT DOCUMENTS

| | | |
|---|---|---|
| 2002/0156242 A1 | 10/2002 | Tamatani et al. |
| 2003/0124149 A1 | 7/2003 | Shalaby et al. |
| 2005/0085433 A1 | 4/2005 | Breidenstein et al. |
| 2006/0002929 A1 | 1/2006 | Khare et al. |
| 2007/0122378 A1 | 5/2007 | Freeman et al. |
| 2008/0069795 A1 | 3/2008 | Rabb |
| 2009/0055944 A1 | 2/2009 | Korman et al. |
| 2010/0166740 A1 | 7/2010 | Endl et al. |
| 2010/0203056 A1 | 8/2010 | Irving et al. |
| 2011/0065902 A1 | 3/2011 | Sleeman et al. |
| 2015/0239978 A1 | 8/2015 | Marodon et al. |
| 2015/0307620 A1 | 10/2015 | Vella et al. |
| 2016/0002336 A1 | 1/2016 | Chen |
| 2016/0024211 A1 | 1/2016 | Chen |
| 2016/0145344 A1 | 5/2016 | Akbari |
| 2016/0215059 A1 | 7/2016 | Liu et al. |
| 2016/0264666 A1 | 9/2016 | Faget et al. |
| 2016/0304610 A1 | 10/2016 | Sazinsky et al. |

FOREIGN PATENT DOCUMENTS

| | | |
|---|---|---|
| EP | 1286668 B1 | 4/2005 |
| EP | 1740617 B1 | 10/2013 |
| EP | 2691419 B1 | 11/2016 |
| RU | 2540490 C2 | 2/2015 |
| WO | WO-1998/003821 A2 | 1/1998 |
| WO | WO-1999/015553 A2 | 4/1999 |
| WO | WO-2001/014424 A2 | 3/2001 |
| WO | WO-2001/087981 A2 | 11/2001 |
| WO | WO-2005/103086 A1 | 11/2005 |
| WO | WO-2006/133396 A2 | 12/2006 |
| WO | WO-2007/005874 A2 | 1/2007 |
| WO | WO-2007/113648 A2 | 10/2007 |
| WO | WO-2007/133290 A2 | 11/2007 |
| WO | WO-2008/083174 A2 | 7/2008 |
| WO | WO-2008/137915 A2 | 11/2008 |
| WO | WO-2009/070642 A1 | 6/2009 |
| WO | WO-2009/126688 A2 | 10/2009 |
| WO | WO-2009/141239 A1 | 11/2009 |
| WO | WO-2010/036959 A2 | 4/2010 |
| WO | WO-2010/056804 A1 | 5/2010 |
| WO | WO-2010/077634 A1 | 7/2010 |
| WO | WO-2010/089411 A2 | 8/2010 |
| WO | WO-2011/004192 A1 | 1/2011 |
| WO | WO-2011/020024 A2 | 2/2011 |
| WO | WO-2011/041613 A2 | 4/2011 |
| WO | WO-2011/066389 A1 | 6/2011 |
| WO | WO-2011/071871 A1 | 6/2011 |
| WO | WO-2011/073180 A1 | 6/2011 |
| WO | WO-2011/097477 A1 | 8/2011 |
| WO | WO-2011/158009 A1 | 12/2011 |
| WO | WO-2012/131004 A2 | 10/2012 |
| WO | WO-2012/145493 A1 | 10/2012 |
| WO | WO-2012/174338 A2 | 12/2012 |
| WO | WO-2013/061078 A1 | 5/2013 |
| WO | WO-2013/061098 A2 | 5/2013 |
| WO | WO-2013/079174 A1 | 6/2013 |
| WO | WO-2013/173223 A1 | 11/2013 |
| WO | WO-2013/181634 A2 | 12/2013 |
| WO | WO-2014/033327 A1 | 3/2014 |
| WO | WO-2014/055897 A2 | 4/2014 |
| WO | WO-2014/089113 A1 | 6/2014 |
| WO | WO-2014/100079 A1 | 6/2014 |
| WO | WO-2014/116846 A2 | 7/2014 |
| WO | WO-2014/159562 A1 | 10/2014 |
| WO | WO-2014/165082 A2 | 10/2014 |
| WO | WO-2015/040401 A1 | 3/2015 |
| WO | WO-2015/049537 A1 | 4/2015 |
| WO | WO-2015/061668 A1 | 4/2015 |
| WO | WO-2015/109124 A1 | 7/2015 |
| WO | WO-2015/112800 A1 | 7/2015 |
| WO | WO-2015/112805 A1 | 7/2015 |
| WO | WO-2015/112900 A1 | 7/2015 |
| WO | WO-2015/132580 A1 | 9/2015 |
| WO | WO-2015/136541 A2 | 9/2015 |
| WO | WO-2015/173267 A1 | 11/2015 |
| WO | WO-2015/179654 A1 | 11/2015 |
| WO | WO-2015/181342 A1 | 12/2015 |
| WO | WO-2016/000619 A1 | 1/2016 |
| WO | WO-2016/007235 A1 | 1/2016 |
| WO | WO-2016/022630 A1 | 2/2016 |
| WO | WO-2016/028656 A1 | 2/2016 |
| WO | WO-2016/030350 A1 | 3/2016 |
| WO | WO-2016/061142 A1 | 4/2016 |
| WO | WO-2016/106302 A1 | 6/2016 |
| WO | WO-2016/111645 A1 | 7/2016 |
| WO | WO-2016/120789 A1 | 8/2016 |
| WO | WO-2016/149201 A2 | 9/2016 |
| WO | WO-2016/154177 A2 | 9/2016 |
| WO | WO-2016/160792 A1 | 10/2016 |
| WO | WO-2016/191643 A2 | 12/2016 |
| WO | WO-2016/197367 A1 | 12/2016 |
| WO | WO-2017/020291 A1 | 2/2017 |
| WO | WO-2017/020801 A1 | 2/2017 |
| WO | WO-2017/020858 A1 | 2/2017 |
| WO | WO-2017/030823 A2 | 2/2017 |
| WO | WO-2017/034916 A1 | 3/2017 |
| WO | WO-2017/037707 A1 | 3/2017 |
| WO | WO-2017/053748 A2 | 3/2017 |
| WO | WO-2017/059095 A1 | 4/2017 |
| WO | WO-2017/070423 A1 | 4/2017 |
| WO | WO-2017/087587 A1 | 5/2017 |
| WO | WO-2017/213695 A1 | 12/2017 |
| WO | WO-2017/220988 A1 | 12/2017 |
| WO | WO-2017/025221 A1 | 2/2018 |
| WO | WO-2018/045110 A1 | 3/2018 |
| WO | WO-2018/047178 A1 | 3/2018 |
| WO | WO-2018/085358 A1 | 5/2018 |
| WO | WO-2018/115859 A1 | 6/2018 |
| WO | WO-2018/187191 A1 | 10/2018 |
| WO | WO-2018/187613 A1 | 10/2018 |

OTHER PUBLICATIONS

Rudikoff, S et al. (1982) Proc. Natl. Acad. Sci. USA, 79:1979-1983.*
Colman, PM (1994) Research in Immunology, Elsevier, NY, 145(1):33-36.*
Search and Examination Report for European Patent Application No. 18814991.8, dated Jul. 16, 2021.
Baruch, et al., Aging-Induced type I Interferon Response at the Choroid Plexus Negatively Affects Brain Function, Science 346(6205): 89-93 (2014).
Baruch, et al., Breaking Immune Tolerance by Targeting Foxp3(+) Regulatory T Cells Mitigates Alzheimer's Disease Pathology, Nat Commun. 6: 7967-7978 (2015).
Baruch, et al., Cerebral Nitric Oxide Represses Choroid Plexus NFKB-Dependent Gateway Activity for Leukocyte Trafficking, EMBO J. 34(13): 1816-1828 (2015).
Baruch, et al., CNS-Specific Immunity at the Choroid Plexus Shifts Toward Destructive Th2 Inflammation in Brain Aging, Proc. Natl. Acad. Sci. U. S. A. 110 (6): 2264-2269 (2013).
Baruch and Schwartz, CNS-specific T Cells Shape Brain Function via the Choroid Plexus, Brain Behav. Immun. 34: 11-16 (2013).
Cauvin et al. (2015) Advantages and Limitations of Commonly Used Nonhuman Primate Species in Research and Development of Biopharmaceuticals in the Nonhuman Primate in Nonclinical Drug Development and Safety Assessment (Academic Press), 379-395.
Kunis, et al., IFN-γ-Dependent Activation of the Brain's Choroid Plexus for CNS Immune Surveillance and Repair, Brain 136: 3427-3440 (2013).
Kunis, et al., Immunization with a Myelin-Derived Antigen Activates the Brain's Choroid Plexus for Recruitment of Immunoregulatory Cells to the CNS and Attenuates Disease Progression in a Mouse Model of ALS, J. Neurosci. 35(16): 6381-6393 (2015).
Rosenzweig, et al., PD-1/PD-L1 Checkpoint Blockade Harnesses Monocyte-Derived Macrophages to Combat Cognitive Impairment in a Tauopathy Mouse Model, Nat Commun. 10(1): 465-479 (2019).
Schwartz and Baruch, The Resolution of Neuroinflammation in Neurodegeneration: Leukocyte Recruitment via the Choroid Plexus, EMBO J. 33(1): 7-20 (2014).

(56) References Cited

OTHER PUBLICATIONS

Kiefer et al., "Immunocytokines and bispecific antibodies: two complementary strategies for the selective activation of immune cells at the tumor site", Immunological Reviews, Feb. 10, 2016, 270(1): 178-192.
Abiko et al., "PD-L 1 on tumor cells is induced in ascites and promotes peritoneal dissemination of ovarian cancer through CTL dysfunction", Clin Cancer Res, 19(6):1363-74 (2013).
Alexandrov et al. "Signatures of mutational processes in human cancer." Nature. Aug. 22, 2013;500(7463):415-21.
Barbie, et al., "Systematic RNA interference reveals that oncogenic KRAS-driven cancers require TBK1 " Nature, 2009; 462(7269)108-12, plus 22 pages supplemental materials.
Baruch et al. "PD-1 immune checkpoint blockade reduces pathology and improves memory in mouse models of Alzheimer's disease." Nat Med, 2016; 22(2):135-9, plus 296 pages supplemental material.
Beer et al., "Randomized, Double-Blind, Phase III Trial of Ipilimumab Versus Placebo in Asymptomatic or Minimally Symptomatic Patients with Metastatic Chemotherapy-Naïve Castration-Resistant Prostate Cancer," Journal of Clinical Oncology, 35(1): 40-51 (2019).
Beier et al. "Induction, binding specificity and function of human ICOS." Eur J Immunol. Dec. 2000;30(12):3707-17.
Binnewies et al., "Understanding the tumor immune microenvironment (TIME) for effective therapy," Nature Medicine, Published online Apr. 23, 2018 (10 pages).
Blank et al., "PD-L1/B7H-1 inhibits the effector phase of tumor rejection by T cell receptor (TCR) transgenic COB+ T cells" 64(3):1140-5 (2004).
Bos et al., "Transient regulatory T cell ablation deters oncogene-driven breast cancer and enhances radiotherapy," J Exp Med 210(11):2434-2446 2013.
Boschetti et al., "Therapy with Anti-TNFα Antibody Enhances No. and Function of FOXP3+ Regulatory T Cells in Inflammatory Bowel Diseases," AGA Abstracts, S-743 (2010).
Brahmer et al., "Phase I study of single-agent anti-programmed death-1 (MDX-1106) in refractory solid tumors: safety, clinical activity, pharmacodynamics, and immunologic correlates", J Clin Oncol, 28(19):3167-75 (2010).
Brahmer et al., "Safety and activity of anti-PD-L 1 antibody in patients with advanced cancer", N Engl J Med, 366 (26):2455-65 (2012).
Briskin, "Efficacy of Anti-ICOS Agonist Monoclonal Antibodies in Preclinical Models Provides a Rationale for Clinical Development for cancer immunotherapy," Presentation SITC 2015, 22 pages.
Brown et al., "Blockade of programmed death-1 ligands on dendritic cells enhances T cell activation and cytokine production", J Immunol, 170(3):1257-66 (2003).
Buonfiglio et al., "The T cell activation molecule H4 and the CD28-like molecule ICOS are identical," Eur. J. Immunol., 30:3463-3467 (2000).
Burmeister et al., "ICOS Controls the Pool Size of Effector-Memory and Regulatory T Cells," J. Immunol., 180(2): 774-782 (2008).
Burris III et al., "Phase 1 Safety of ICOS Agonist Antibody JTX-2011 Alone and with Nivolumab (Nivo) in Advanced Solid Tumors; Predicted vs. Observed Pharmacokinetics (PK) in ICONIC" (2017).
Butte et al., "Programmed death-1 ligand 1 interacts specifically with the B7-1 costimulatory molecule to inhibit T cell responses", Immunity, 27(1):111-22 (2007).
Camus et al., "Coordination of Intratumoral Immune Reaction and Human Colorectal Cancer Recurrence," Cancer Res 69:2685-93 (2009).
Carthon et al. Preoperative CTLA-4 blockade: Tolerability and immune monitoring in the setting of a presurgical clinical trial. Clin. Cancer Res. 16:2861-2871, (May 15, 2010).
Chattopadhyay et al., "Structural Basis of Inducible Costimulatory Ligand Function: Determination of the Cell Surface Oligomeric State and Functional Mapping of the Receptor Binding Site of the Protein," J. Immunol. 177(6):3920-3929 2006.

Chevalier et al., "Phenotype Alterations in Regulatory T-Cell Subsets in Primary HIV Infection and Identification of Tr1-like Cells at the Main Interleukin 10-Producing CD4+ T Cells," JID, 211: 769-779 (2015).
Collin, "Immune checkpoint inhibitors: a patent review" Expert Opinion on Therapeutic Patents, 26(5): 555-564 (2016).
Conrad et al., "Plasmacytoid dendritic cells and regulatory T cells in the tumor microenvironment: A dangerous liaison." Oncoimmunology. May 1, 2013;2(5):e2388.
Coyle et al. "The CD28-related molecule ICOS is required for effective T cell-dependent immune responses." Immunity. Jul. 2000;13(1):95-105.
Crotty, "T follicular helper cell differentiation, function, and roles in disease." Immunity. Oct. 16, 2014;41(4):529-42.
Curran et al., "PD-1 and CTLA-4 combination blockade expands infiltrating cells and reduces regulatory T and myeloid cells within B16 melanoma tumors", PNAS, 107(9): 4275-4280 (2010).
Currie et al. "Dual Control of Antitumor CD8 T Cells through the Programmed Death-1/Programmed Death-Ligand 1 Pathway and Immunosuppressive CD4 T Cells: Regulation and Counterregulation," J. Immunol., 183(12): 7898-7908 (2009).
Dall et al., "Increasing the affinity of a human IgG1 for the neonatal Fc receptor: Biological consequences." Immunol 2002; 169:5171-5180.
Dana Farber Blog, "Enhancing Immunotherapy: The Race to Make 'Cold' Tumors 'Hot,'" Published Jun. 6, 2018 at https://blog.dana.farber.org/insight/2018/06/enhancing-immunotherapy-race-make-cold-tumors-hot/ (7 pages).
Declaration of Dr. Anil K. Thotakura submitted with Statement of Opposition filed at European Patent Office against European Patent No. EP2482849 on Mar. 6, 2019 (27 pages).
Declaration of Dr. Gwenoline Borhis submitted with Statement of Opposition filed at European Patent Office against European Patent No. EP2482849 on Mar. 6, 2019 (10 pages).
Declaration of Dr. Richard C.A. Sainson, submitted with Statement of Opposition filed at European Patent Office against European Patent No. EP2482849 on Mar. 6, 2019 (8 pages).
Deng et al., "An Agonist Human ICOS Monoclonal Antibody that Induces T Cell Activation and Inhibits Proliferation of a Myeloma Cell Line," Hybridoma and Hybridomics, 23(3): 176-182 (2004).
Deng et al., "Extrafollicular CD4+ T-B interactions are sufficient for inducing autoimmune-like chronic graft-versus-host disease," Nature Communications 2017, 18:978, (17 pages).
Dong et al., "B7-H1, a third member of the B7 family, co-stimulates T-cell proliferation and interleukin-10 secretion" Nat Med, 5(12):1365-9 (1999).
Dong et al. "ICOS co-stimulatory receptor is essential for T-cell activation and function." Nature. 2001; 409(6816):97-101.
Dong et al., "Tumor-associated B7-H1 promotes T-cell apoptosis: a potential mechanism of immune evasion", Nat Med, 8(8):793-800 (2002).
Dranoff et al., "Vaccination with irradiated tumor cells engineered to secrete murine granulocyte-macrophage colony-stimulating factor stimulates potent, specific, and long-lasting anti-tumor immunity," Proc. Natl. Acad. Sci. USA 90: 3539-3543 (1993).
Driessens et al., "Costimulatory and coinhibitory receptors in anti-tumor immunity," Immunol. Rev. 229(1) : 126-144 (2009).
Eager et al., "GM-CSF Gene-Transduced Tumor Vaccines," Molecular Therapy 12(1): 18-27 (2005).
Elpek et al., "Abstract A059: Efficacy of anti-ICOS agonist monoclonal antibodies in preclinical tumor models proves a rationale for clinical development as cancer immunotherapeutics," Cancer Immunology Research, (2016).
EuropeanBiotechnology.com, "Roche's anti-PD-L1 fails in bladder cancer," Published May 10, 2017 at https://european-biotechnology.com/up-to-date/latest-news/news/roches-anti-pd-l1-fails-in-bladder-cancer.html (2 pages).
Faget et al., "ICOS-Ligand Expression on Plasmacytoid Dendritic Cells Supports Breast Cancer Progression by Promoting the Accumulation of Immunosuppressive CD4+ T Cells," Cancer Res., 72(23): (2012).

(56) References Cited

OTHER PUBLICATIONS

Fan et al. "Engagement of the ICOS pathway markedly enhances efficacy of CTLA-4 blockade in cancer immunotherapy." J Exp Med. Apr. 7, 2014;211(4):715-25.

Fehrenbacher et al., "Atezolizumab versus docetaxel for patients with previously treated non-small-cell lung cancer (POPLAR): a multicentre, open-label, phase 2 randomised controlled trial", Lancet, 387(10030):1837-46 (2016).

Feyler et al., "Tumour Cell Generation of Inducible Regulatory T-Cells in Multiple Myeloma is Contact-Dependent and Antigen-Presenting Cell-Independent," PLoS ONE, 7(5): 10 pages (2012).

Francisco et al., "PD-L1 regulates the development, maintenance, and function of induced regulatory T cells," J. Exp. Med. 206(13): 3015-3029 (2009).

Freeman et al., "Engagement of the PD-1 immunoinhibitory receptor by a novel B7 family member leads to negative regulation of lymphocyte activation", J Exp Med, 192(7): 1027-34 (2000).

French et al., "What is conservative substitution?" J. Mol. Evol. 1983; 19;171-5.

Fu et al., "The ICOS/ICOSL pathway is required for optimal antitumor responses mediated by anti-CTLA-4 therapy." Cancer Res. Aug. 15, 2011;71(16):5445-54.

Galluzzi et al, "Immunological mechanisms underneath the efficacy of cancer therapy." Canc. Imm. Res. 4:895-902 (2016).

Galon et al., "Approaches to treat immune hot, altered and cold tumours with combination immunotherapies," Nature Reviews Drug Discovery, Published online Jan. 4, 2019 (22 pages).

Gerritsen et al., "A dose-escalation trial of GM-CSF-gene transduced allogeneic prostate cancer cellular immunotherapy in combination with a fully human anti-CTLA antibody (MDX-010, ipilimumab) in patients with metastatic hormone-refractory prostate cancer (mHRPC)" Journal of Clinical Oncology, 24(18), Published online Dec. 12, 2016 at http://ascopubs.org/doi/abs/10.1200/jco.2006.24.18_suppl.2500 (5 pages).

Gül et al., "Antibody-Dependent Phagocytosis of Tumor Cells by Macrophages: A Potent Effector Mechanism of Monoclonal Antibody Therapy of Cancer", Cancer Res., 75(23), Dec. 1, 2015.

Hamada et al., "Carrier Cell-mediated Delivery of a Replication-competent Adenovirus for Cancer Gene Therapy," Molecular Therapy 15(6): 1121-1128 (2007).

Hanzelmann, et al., "GSVA: gene set variation analysis for microarray and RNA-Seq data," BMC Bioinformatics, vol. 14, No. 1, p. 7, 2013.

Harvey et al., "Efficacy of Anti-ICOS Agonist Monoclonal Antibodies in Preclinical Models Provides a Rationale for Clinical Development for cancer immunotherapy," Journal for Immunotherapy of Cancer 3(Suppl2):O9 (2015).

Hasenhindl et al., "Creating stable stem regions for loop elongation in Fcabs—Insights from combining yeast surface display, in silico loop reconstruction and molecular dynamics simulations", Biochimica et Biophysica Acta 1844: 1530-1540 (2014).

Helfand, "AstraZeneca's Imfinzi fails key Mystic trial in lung cancer. What now?" Published online Nov. 16, 2018 at https://www.fiercepharma.com/pharma/astrazeneca-s-imfinzi-fails-key-mystic-trial-lung-cancer-what-now (4 pages).

Herbst et al., "Predictive correlates of response to the anti-PD-L 1 antibody MPDL3280A in cancer patients", Nature, 515(7528):563-7 (2014).

Hirano et al., "Blockade of B7-H1 and PD-1 by monoclonal antibodies potentiates cancer therapeutic immunity", Cancer Res, 65(3):1089-96 (2005).

Hirsch et al., "Biomarker Driven Indication Selection in JTX-2011 ICONIC Clinical Trial," poster presented at the American Society of Clinical Oncology (ASCO) Annual Meeting, Jun. 2-6, 2017 in Chicago, Illinois.

Hirsch, "A biomarker-driven approach for the development of the ICOS agonist antibody, JTX-2011, presentation for the Society for Immunotherapy of Cancer," Nov. 8, 2017 in National Harbor, Maryland, 11 pages.

Hodge et al., "Multiple Costimulatory Modalities Enhance CTL Avidity," J. Immunol. 174: 5994-6004 (2005).

Hodi et al., "Immunologic and clinical effects of antibody blockade of cytotoxic T lymphocyte-associated antigen 4 in previously vaccinated cancer patients." PNAS Feb. 26, 2008;105(8):3005-10.

Houot et al., "Therapeutic effect of CD137 immunomodulation in lymphoma and its enhancement by Treg depletion," Blood 114:3431-3438 2009.

Hutloff et al. "ICOS is an inducible T-cell co-stimulator structurally and functionally related to CD28." Nature. 1999; 397(6716):263-6.

Idusogie et al., "Engineered antibodies with increased activity to recruit complement." J. Immunol., 2001, 166:2571-2575.

Inman, "Costimulation, Coinhibition, and Cancer." Current Cancer Drug Targets, 7, 15-30 (2007).

International Search Report & Written Opinion dated Sep. 22, 2017; PCT/GB2017/051794.

International Search Report & Written Opinion dated Sep. 25, 2017; PCT/GB2017/051795.

International Search Report & Written Opinion dated Oct. 4, 2017; PCT/GB2017/051796.

International Search Report & Written Opinion dated Feb. 5, 2018; PCT/GB2017/052352.

International Search Report & Written Opinion dated May 3, 2018; PCT/GB2017/053826.

International Search Report & Written Opinion dated May 7, 2019; PCT/GB2018/051714.

International Search Report & Written Opinion dated Apr. 1, 2019, PCT/GB2018/053698.

International Search Report & Written Opinion dated May 27, 2019, PCT/GB2018/053701.

Iwai et al., "Involvement of PD-L1 on tumor cells in the escape from host immune system and tumor immunotherapy by PD-L 1 blockade", Proc Natl Acad Sci USA, 99(19):12293-7 (2002).

Janke et al., "Eminent role of ICOS costimulation for T cells interacting with plasmacytoid dendritic cells," Immunology, 11: 353-360 (2006).

Jian-Fei Tu et al., "Regulatory T cells, especially ICOS+ FOXP3(+) regulatory T cells, are increased in the hepatocellular carcinoma microenvironment and predict reduced survival", Scientific Reports, vol. 6, Oct. 2016.

Jounce Therapeutics, "Advancing Cancer Immunotherapy Worldwide" Presentation for SITC Conference, Nov. 8-12, 2017.

Jounce Therapeutics Press Release, Jounce Therapeutics Initiates Phase 2 Portion of ICONIC Study of JTX-2011 in Patients with Advanced Solid Tumors, Apr. 20, 2017, 3 pages.

Jounce Therapeutics Press Release, Jounce Therapeutics Initiates Phase 1/2 ICONIC Study of JTX-2011 in Patients with Advanced Solid Tumors, Sep. 7, 2016, 2 pages.

Jounce Therapeutics Press Release, Jounce Therapeutics Presents Data Highlighting Advances From Two Programs in its Immuno-Oncology Pipeline at the 2016 AACR Annual Meeting, Apr. 17, 2016, 2 pages.

Jounce Therapeutics Press Release, Jounce Therapeutics Presents Phase 1 Data from ICONIC Study of JTX-2011 in Patients with Advanced Solid Tumors at 2017 ASCO Annual Meeting, Jun. 5, 2017, 6 pages.

Jounce Therapeutics Press Release, Jounce Therapeutics to Present Program Updates at AACR Annual Meeting 2016, Mar. 16, 2016, 2 pages.

Jounce Therapeutics Press Release, Jounce Therapeutics to Present at AACR Annual Meeting on JTX-2011 Cancer Immunotherapy Program, Mar. 22, 2017, 5 pages.

Jounce Therapeutics Press Release, Jounce Therapeutics to Present Phase 1 Data from JTX-2011 ICONIC Trial at 2017 American Society of Clinical Oncology Annual Meeting, May 17, 2017, 5 pages.

Kaiser et al., "Reduced tumor-antigen density leads to PD-1/PD-L 1-mediated impairment of partially exhausted COB+ T cells", Eur J Immunol, 42(3):662-71 (2012).

Keir et al., "PD-1 and its Ligands in Tolerance and Immunity," Annu. Rev. Immunol. 26: 677-704 (2008).

Kilpatrick et al., "Rapid development of affinity matured monoclonal antibodies using RIMMS;" Hybridoma, 1997; 16(4):381-9.

(56) References Cited

OTHER PUBLICATIONS

Kraman et al. "A LAG-3/PD-L1 bispecific antibody inhibits tumour growth in two syngeneic colon carcinoma patients," Keystone Symposium, 2017, Poster 3005.
Kroemer et al. "Immunologic Cell Death in Cancer Therapy," Ann Rev Immunol. 2013; 31:51-72.
Langer, "New methods of drug delivery." (1990) Science 249:1527-1533.
Lazar et al., "Engineered antibody Fc variants with enhanced effector function," 2006, Proc. Natl. Acad. Sci. U.S.A., Mar. 14; 103(11):4005-10.
Le et al., "Follicular B Lymphomas Generate Regulatory T Cells via the ICOS/ICOSL Pathway and are Susceptible to Treatment by Anti-ICOS/ICOSL Therapy," Cancer Res., 76(16):4648-4660 (2016).
Lee et al., "Complete humanization of the mouse immunoglobulin loci enables efficient therapeutic antibody discovery." Nature Biotechnology, 2014; 32:6-363.
Lefranc "IMGT unique numbering for immunoglobulin and T cell receptor variable domains and Ig superfamily V-like domains," Dev Comp Immunol. 2003; 27(1):55-77.
Liakou et al. "CTLA-4 blockade increases IFNgamma-producing CD4+ICOShi cells to shift the ratio of effector to regulatory T cells in cancer patients." Proc Natl Acad Sci U S A. Sep. 30, 2008;105(39):14987-92.
Lin et al., "The PD-1/PD-L1 complex resembles the antigen-binding Fv domains of antibodies and T cell receptors", Proc Natl Acad Sci USA, 105(8):3011-6 (2008).
Liston et al., "Dicer-dependent microRNA pathway safeguards regulatory T cell function," J Exp Med 205(9): 1993-2004 (2008).
Löhning et al., "Expression of ICOS in Vivo Defines CD4+ Effector T Cells with High Inflammatory Potential and a Strong Bias for Secretion of Interleukin 10," J. Exp. Med., 197(2): 181-193 (2003).
Mak et al., "Costimulation through the inducible costimulator ligand is essential for both T helper and B cell functions in T cell-dependent B cell responses." Nat Immunol. 2003; 4(8):765-72.
Martin-Orozco et al., "Melanoma Cells Express ICOS Ligand to Promote the Activation and Expansion of T-Regulatory Cells," Cancer Research 70(23):9581-9590 2010.
McAdam et al., "Mouse Inducible Costimulatory Molecule (ICOS) Expression is Enhanced by CD28 Costimulation and Regulates Differentiation of CD4+ T Cells," J. Immunology, 165:5035-5040 (2000).
Metzger et al., "ICOS Promotes the Function of CD4+ Effector T Cells during Anti-OX40-Mediated Tumor Rejection," Cancer Res, 76(13): 3684-3689 (2016).
Michaelson, "Preclinical Assessment of JTX-2011, An Agonist Antibody Targeting ICOS, Supports Evaluation in ICONIC Clinical Trial," Presentation 2017, 27 pages.
Moore et al., "Anti-PD1 x anti-ICOS bispecific antibody XmAb23104 brings together PD1 blockade and ICOS costimulation to promote human T cell activation and proliferation" SITC 2017 Poster P347.
Moynihan et al., "Eradication of large established tumors in mice by combination immunotherapy that engages innate and adaptive immune responses," Nature Medicine, 12 pages (2016).
Nair et al., "A simple practice guide for dose conversion between animals and human." J Basic Clin Pharma 2016;7:27-31.
Natsume et al., "Engineered Antibodies of IgG1/IgG3 Mixed Isotype with Enhanced Cytotoxic Activities." Cancer Res., 68: 3863-3872, (May 15, 2008).
Natsume et al., "Improving effector functions of antibodies for cancer treatment : Enhancing ADCC and CDC," 2009, Drug Des. Devel. Ther., 3:7-16.
Nemunaitis, "Vaccines in Cancer: GVAX®, a GM-CSF gene vaccine," Expert Rev. Vaccines 4(3): 259-274 (2005).
Neri et al., "Immunocytokines for cancer treatment: past, present and future", Current Opinion in Immunology, Elsevier, Oxford, GB vol. 40, Apr. 6, 2016 (Apr. 6, 2016), pp. 96-102.
Odegard et al., "ICOS Controls Effector Function but Not Trafficking Receptor Expression of Kidney-Infiltrating Effector T Cells in Murine Lupus," J Immunology 182:4076-84 (2009).

Ohaegbulam et al., "Human cancer immunotherapy with antibodies to the PD-1 and PD-L1 pathway," Trends Mol Med., 21(1): 24-33, 23 pages (2014).
Powell et al. "Compendium of excipients for parenteral formulations" PDA J Pharm Sci Technol, 1998; 52:238-311.
Preston, et al., "The ratios of CD8+ T cells to CD4+CD25+ FOXP3+ and FOXP3-T cells correlate with poor clinical outcome in human serous ovarian cancer." PLoS One Nov. 14;8(11):e80063 (2013).
Pühler et al., "Generation of a recombinant oncolytic Newcastle disease virus and expression of a full IgG antibody from two transgenes," Gene Ther. 15: 371-383 (2008).
Quezada et al., "CTLA4 blockade and GM-CSF combination immunotherapy alters the intratumor balance of effector and regulatory T cells," Journal of Clinical Investigation, 116(7): 1935-45 (2006).
Redoglia et al., "Characterization of H4: a mouse T Lymphocyte activation molecule functionally associated with the DC3/T cell receptor," Eur. J. Immunol., 11: 2781-9 (1996) (abstract only).
Rosenberg et al., "Atezolizumab in patients with locally advanced and metastatic urothelial carcinoma who have regressed following treatment with platinum-based chemotherapy: a single-arm, multicentre, phase 2 trial", Lancet, 387(10031):1909-20 (2016).
Rossi et al., "Optimization of multivalent bispecific antibodies and immunocytokines with improved in vivo properties", Bioconjug Chem, 24(1):63-71 (2013).
Rubio, et al. "Ex vivo identification, isolation and analysis of tumor-cytolytic T cells." Nat Med. 2003;9(11):1377-82, plus 9 pages supplemental material.
Rudikoff et al., "Single Amino Acid Substitution Altering Antigen-Binding Specificity," Proc. Natl. Acad. Sci., 79: 1978-1983 (1982).
Sainson et al., "A novel antibody targeting ICOS increases intratumoural cytotoxic to regulatory T cell ratio and induces tumour regression," bioRxiv preprint first posted online Sep. 16, 2019, https://www.biorxiv.org/content/biorxiv/early/2019/09/16/771493.full.pdf— Retrieved Oct. 21, 2019 (80 pages).
Sanmamed et al., "Agonists of Co-stimulation in Cancer Immunotherapy Directed Against CD137, OX40, GITR, CD27, CD28, and ICOS," Seminars in Oncology, 42(4): 640-655 (2015).
Sato et al., "Spatially selective depletion of tumor-associated regulatory T cells with near-infrared photoimmunotherapy," Science Translational Medicine, 2016; 8(352):1-12, plus 27 pages supplemental material.
Sears et al., "ICONIC: Phase 1/2 Trial of ICOS Agonist JTX-2011 Alone and in Combination with Nivolumab (nivo)" (2017).
Selby et al., "Anti-CTLA-4 antibodies of IgG2a isotype enhance antitumor activity through reduction of intratumoral regulatory T cells." Cancer immunology research, 1(1):32-42 2013.
Seshasayee et al., "In vivo blockade of OX40 ligand inhibits thymic stromal lymphopoietin driven atopic inflammation," J Clin Invest 117(12): 3868-3878 (2007).
Sharma et al., "Immune Checkpoint Targeting in Cancer Therapy: Toward Combination Strategies with Curative Potential," Cell, 161: 205-214 (2015).
Sharma et al., "The future of immune checkpoint therapy," Science, 348(6230): 56-61 (2015).
Shields et al., "High resolution mapping of the binding site on human IgG1 for Fc gamma RI, Fc gamma RII, Fc gamma RIII, and FcRn and design of IgG1 variants with improved binding to the Fc gamma R." 2001, J. Biol. Chem., Mar. 2; 276(9):6591-604).
Shields et al. "Lack of Fucose on Human IgG1 N-Linked Oligosaccharide Improves Binding to Human FcγRIII and Antibody-dependent Cellular Toxicity" (2002) JBC 277:26733.
Shirakawa, "The Current Status of Adenovirus-based Cancer Gene Therapy," Mol. Cells, 25(4): 462-466 (2008).
Sim et al., "IL-2 therapy promotes suppressive ICOS+ Treg expansion in melanoma patients," J Clin Invest, 124(1): 99-110 (2014).
Sim et al., "IL-2 variant circumvents ICOS+ regulatory T cell expansion and promotes NK cell activation," Cancer Immunol Res 2016.
Simpson et al., "Regulation of CD4 T cell activation and effector function by inducible costimulatory (ICOS)," Current Opinion in Immunology 22: 326-332 (2010).

(56) References Cited

OTHER PUBLICATIONS

Simpson et al., "Fc-dependent depletion of tumor-infiltrating regulatory T cells co-defines the efficacy of anti-CTLA-4 therapy against melanoma." J. Exp. Med. 210(9):1695-1710 2013.

Solomon et al., "TIGIT: a novel immunotherapy target moving from bench to bedside," Cancer Immunol Immunother; 67(11):1659-1667 (2018).

Song et al., "Overexpression of B7-H1 correlates with malignant cell proliferation in pancreatic cancer", Oncol Rep, 31 (3):1191-8 (2014).

Statement of Opposition filed at European Patent Office against European Patent No. EP2482849 on Mar. 6, 2019 (62 pages).

Strauss et al., "Expression of ICOS on Human Melanoma-Infiltrating $CD4^+CD25^{high}Foxp3^+$ T Regulatory Cells: Implications and Impact on Tumor-Mediated Immune Suppression," J. Immunol 180(5): 2967-2980 (2008).

Strohl, "Fusion Proteins for Half-Life Extension of Biologies as a Strategy to Make Biobetters." BioDrugs (2015) 29:215-239.

Swallow et al., "B7h, a novel costimulatory homolog of B7.1 and B7.2, is induced by TNFalpha." Immunity. Oct. 1999;11(4):423-32.

Taylor et al., "The classification of amino acid conservation." J. Theor. Biol., 1986; 119;205-218.

Taylor, "AstraZeneca tremelimumab fails another phase 3 cancer trial," Published online Dec. 7, 2018 at https://fiercebiotech.com/biotech/astrazeneca-s-tremelimumab-fails-another-phase-3-cancer-trial (4 pages).

Thompson et al., "Tumor B7-H1 is associated with poor prognosis in renal cell carcinoma patients with longterm follow-up", Cancer Res, 66(7):3381-5 (2006).

Topalian et al., "Safety, activity, and immune correlates of anti-PD-1 antibody in cancer", N Engl J Med, 366 (26):2443-54 (2012).

Tu et al., "Regulatory T cells, especially ICOS $FOXP3^+$ regulatory T cells, are increased in the hepatocellular carcinoma microenvironment and predict reduced survival," Scientific Reports, 6:35056 (2016).

Ueha et al., "Robust Antitumor Effects of Combined Anti-CD4-Depleting Antibody and Anti-PD-1/PD-LI Immune Checkpoint Antibody Treatment in Mice," Cancer Immunology Research, 3(6); pp. 631-640 (2015).

U.S. National Library of Medicine, "Anti-ICOS Monoclonal Antibody MEDI-570 in Treating Patients with Relapsed or Refractory Peripheral T-cell Lymphoma Follicular Variant or Angioimmunoblastic T-cell Lymphoma," ClinicalTrials.gov Identifier No. NCT02520791. First posted Aug. 13, 2015. Retrieved at https://clinicaltrials.gov/ct2/show/NCT02520791.

Van Berkel et al., "CD28 and ICOS: Similar or separate costimulators of T cells?" Immunology Letters 105: 115-122 (2006).

Van Elsas et al., "Combination Immunotherapy of B16 Melanoma Using Anti-Cytotoxic T Lymphocyte-associated Antigen 4 (CTLA-4) and Granulocyte/Macrophage Colony-Stimulating Factor (GM-CSF)-producing Vaccines Induces Rejection of Subcutaneous and Metastatic Tumors Accompanied by Autoimmune Depigmentation," J Exp Med 190(3): 355-66 (1999).

Vazquez-Lombardi et al., "Potent antitumour activity of interleukin-2-Fc fusion proteins requires Fc-mediated depletion of regulatory T-cells," Nature Communications, vol. 8, May 12, 2017 (May 12, 2017), pp. 1-12.

Vetterman et al., "A signalling-enhanced chimeric receptor to activate the ICOS pathway in T cells," Journal of Immunological Methods 424: 14-19 (2015).

Vonderheide et al. 2010. "Tremelimumab in combination with exemestane in patients with advanced breast cancer and treatment-associated modulation of inducible costimulator expression on patient T cells." Clin. Cancer Res. 16:3485-3494.

Wang et al. "Costimulation of T cells by B7-H2, a B7-like molecule that binds ICOS." Blood. Oct. 15, 2000;96(8):2808-13.

Wang et al., "In Vitro Characterization of the Anti-PD-1 Antibody Nivolumab, BMS-936558, and in Vivo Toxicology in Non-Human Primates", Cancer Immunology Research, vol. 2, No. 9, May 28, 2014 (May 28, 2014), pp. 846-856.

Ward et al., "Targeting Costimulatory Pathways for Tumor Immunotherapy," International Reviews of Immunology, 26:161-196 (2007).

West et al., "PD-L 1 blockade synergizes with IL-2 therapy in reinvigorating exhausted T cells", J Clin Invest, 123(6):2604-15 (2013).

Wozniak-Knopp et al., "Introducing antigen-binding sites in structural loops of immunoglobulin constant domains : Fc fragments with engineered HER2/neu-binding sites and antibody properties," Protein Engineering, Design & Selection, 23(4) ; 289-297 (2010).

Yang et al., "Programmed cell death-ligand 1 expression in surgically resected stage I pulmonary adenocarcinoma and its correlation with driver mutations and clinical outcomes", Eur J Cancer, 50(7):1361-9 (2014).

Yap et al., "ICONIC : Biologic and clinical activity of first in class ICOS against antibody JTX-2011 +/− nivolumab (nivo) in patients with advanced cancers," Presented at 2018 ASCO Annual Meeting (18 pages).

Yusa K, et al. "A hyperactive piggyBac transposase for mammalian applications," Proc Natl Acad Sci U S A. Jan. 25, 2011.

Zang et al., "The B7 family and cancer therapy: costimulation and coinhibition," Clinical Cancer Research, 13(18): 5271-5279 (2007).

\* cited by examiner

Effect of 1D05-IL2 constructs on proliferation of TF1 βγ cells (II)

(b)

(c)

TIGIT ANTIBODIES, ENCODING NUCLEIC ACIDS AND METHODS OF USING SAID ANTIBODIES IN VIVO

RELATED APPLICATIONS

This application is a national stage filing under 35 U.S.C. § 371 of International Application No. PCT/GB2018/051714, filed on Jun. 20, 2018, which claims priority of British Patent Application No. 1709808.8, filed Jun. 20, 2017. The contents of these applications are each incorporated herein by reference.

SEQUENCE LISTING

The instant application contains a Sequence Listing which has been submitted electronically in ASCII format and is hereby incorporated by reference in its entirety. Said ASCII copy, created on Apr. 5, 2022, is named 718522_SA9-620US_ST25.txt and is 789.7 KB in size.

FIELD OF THE INVENTION

The present invention relates to antibodies specific for one or more antigens selected from anti-TIGIT, PD-L1 and ICOS, bispecific antibodies containing one or more domains with specificity to the target(s), and to immunocytokines comprising an anti-target antibody fused to a cytokine, such as IL-2. The present invention also provides methods of treatment, uses and pharmaceutical compositions comprising the antibodies, bispecific antibodies and immunocytokines.

Antibodies and methods of using the antibodies are described. In particular, antibodies that specifically bind human TIGIT, PD-L1 and/or ICOS antigen and their use in treating various diseases are described.

INTRODUCTION

Immunocytokines (antibody-cytokine fusion proteins) were first reported in the literature in the early 1990s and consisted of whole antibody fusions with cytokines such as lymphotoxin (TNF-α) or interleukin 2 (IL-2). Subsequent studies in GD2-expressing tumour models in mice indicated that the ch14.18 antibody and ch14.18-IL2 immunocytokine both had anti-tumour activity but that the immunocytokine was far more potent than the antibody, even when combined with free IL-2, (see Sabzevari H et al., Proc. Natl. Acad. Sci. USA, 1994, 91:9626-30; Pancook J D, et al, Cancer Immunol. Immunother., 1996, 42:88-92; Becker J C, et al, Proc. Natl. Acad. Sci. USA, 1996, 93:2702-7). In addition, immune-competent mice treated with the immunocytokine, but not the antibody plus IL-2, developed an adaptive immune response dependent on CD8$^+$ T-cells that prevented subsequent tumour challenge (Becker J C, et al, J. Exp. Med., 1996, 183:2361-6; Becker J C, et al, Proc. Natl. Acad. Sci. USA, 1996, 93:7826-31). Thus, the targeting of IL-2 to the tumour microenvironment induces an anti-tumour vaccine effect that is not possible with the antibody, either alone or together with the free cytokine. A related humanized immunocytokine, hu 14.18-IL2, achieved clinical proof of concept in relapsed non-bulky neuroblastoma as monotherapy where it induced a significant number of complete responses in patients with no other treatment options (see Shusterman et al., Journal of Clinical Oncology, 2010, 28(33), 4969-4975). A number of publications describe the ability of this molecule to activate several components of the immune system to kill tumour cells (particularly NK cells and CD8$^+$ T-cells), and develop T-cell memory in order to resist subsequent tumour challenge (Yamane et al 2009; Expert Opi, Investig. Drugs, 18(7): 991-1000; Neal et al., 2004, Clin. Cancer Res., 1010, 4839-4847).

As IL-2 based immunocytokines can have significant side effects, recent efforts have focused on the reduction of toxicity whilst maintaining efficacy. One example is Selectikine (EMD 521873), which has a substitution of aspartic acid for threonine at position 20 of IL-2, a key residue in the binding of IL-2Rβ (Gillies et al., Clinical Cancer Research, 2011, 17(11), 3673-3685). Selectikine, which binds necrotic tissue, has been shown to have good anti-tumour activity, despite its selectivity for the high affinity IL-2R, over the intermediate IL-2R and good tolerability in Phase I studies (Laurent et al, Journal of Translational Medicine, 2013, 11(1), 5. doi.org/10.1186/1479-5876-11-5)

WO2012/178137 (Gillies) and an associated journal article (Gilles, Protein Engineering, Design and Selection, 2013, 26(10), 561-569) describe light chain immunocytokine fusions with tumour targeting antibodies, and modulation of IL-2 activity by the introduction of truncations in the N-terminal part of the cytokine, which decreases signalling through IL-2Rβγ. IL-2 fusion proteins that specifically target IL-2Rβγ have been shown to have increased toxicity compared with wild-type (Vasquez-Lombardi et al. Nat Comm, 2017, DOI: 10.1038/ncomms15373), supporting the notion that decreasing IL-2Rβγ binding may be beneficial in terms of side effects.

An adaptive immune response involves activation, selection, and clonal proliferation of two major classes of lymphocytes termed T-cells and B-cells. After encountering an antigen, T-cells proliferate and differentiate into antigen-specific effector cells, while B-cells proliferate and differentiate into antibody-secreting cells. T-cell activation is a multi-step process requiring several signalling events between the T-cell and an antigen-presenting cell (APC). For T-cell activation to occur, two types of signals must be delivered to a resting T-cell. The first type is mediated by the antigen-specific T-cell receptor (TcR), and confers specificity to the immune response. The second signal, a costimulatory type signal, regulates the magnitude of the response and is delivered through accessory receptors on the T-cell.

A primary costimulatory signal is delivered through the activating CD28 receptor upon engagement of its ligands B7-1 or B7-2. In contrast, engagement of the inhibitory CTLA-4 receptor by the same B7-1 or B7-2 ligands results in attenuation of a T-cell response. Thus, CTLA-4 signals antagonize costimulation mediated by CD28. At high antigen concentrations, CD28 costimulation overrides the CTLA-4 inhibitory effect. Temporal regulation of the CD28 and CTLA-4 expression maintains a balance between activating and inhibitory signals and ensures the development of an effective immune response, while safeguarding against the development of autoimmunity.

Programmed death-1 (PD-1) is a 50-55 kDa type I transmembrane receptor that is a member of the CD28 family. PD-1 is involved in the regulation of T-cell activation and is expressed on T-cells, B cells, and myeloid cells. Two ligands for PD-1, PD ligand 1 (PD-L1) and ligand 2 (PD-L2) have been identified and have co-stimulatory features.

Programmed cell death 1 ligand 1 (PD-L1), also known as cluster of differentiation (CD274) or B7 homolog 1 (B7-H1), is a member of the B7 family that modulates activation or inhibition of the PD-1 receptor. The open reading frame of PD-L1 encodes a putative type 1 transmembrane protein of 290 amino acids, which includes two extracellular Ig domains (a N-terminal V-like domain and a Ig C-like domain), a hydrophobic transmembrane domain and a cytoplasmic tail of 30 amino acids. The 30 amino acid intracellular (cytoplasmic) domain contains no obvious signalling motifs, but does have a potential site for protein kinase C phosphorylation.

The complete amino acid sequence for PD-L1 can be found in NCBI Reference Sequence: NP_054862.1 (SEQ ID NO: 1), which refers to many journal articles, including, for example, Dong, H., et al (1999), "PD-L1, a third member of the B7 family, co-stimulates T-cell proliferation and interleukin-10 secretion," Nat. Med. 5 (12), 1365-1369. The PD-L1 gene is conserved in chimpanzee, Rhesus monkey, dog, cow, mouse, rat, chicken, and zebrafish. The murine form of PD-L1 bears 69% amino acid identity with the human form of PD-L1, and also shares a conserved structure.

In humans, PD-L1 is expressed on a number of immune cell types including activated and anergic/exhausted T-cells, on naive and activated B-cells, as well as on myeloid dendritic cells (DC), monocytes and mast cells. It is also expressed on non-immune cells including islets of the pancreas, Kupffer cells of the liver, vascular endothelium and selected epithelia, for example airway epithelia and renal tubule epithelia, where its expression is enhanced during inflammatory episodes. PD-L1 expression is also found at increased levels on a number of tumours including, but not limited to breast (including but not limited to triple negative breast cancer and inflammatory breast cancer), ovarian, cervical, colon, colorectal, lung, including non-small cell lung cancer, renal, including renal cell carcinoma, gastric, oesophageal, bladder, hepatocellular cancer, squamous cell carcinoma of the head and neck (SCCHN) and pancreatic cancer, melanoma and uveal melanoma.

PD-1/PD-L1 signalling is believed to serve a critical non-redundant function within the immune system by negatively regulating T-cell responses. This regulation is involved in T-cell development in the thymus, in regulation of chronic inflammatory responses and in maintenance of both peripheral tolerance and immune privilege. It appears that upregulation of PD-L1 may allow cancers to evade the host immune system and, in many cancers, the expression of PD-L1 is associated with reduced survival and an unfavourable prognosis. Therapeutic monoclonal antibodies that are able to block the PD-1/PD-L1 pathway may enhance anti-tumoural immune responses in patients with cancer. Published clinical data suggest a correlation between clinical responses with tumoural membranous expression of PD-L1 (Brahmer et al., Journal of Clinical Oncology, 2010, Topalian et al., NEJM, 2012) and a stronger correlation between lack of clinical responses and a lack of PD-L1 protein localized to the membrane (Brahmer et al., Journal of Clinical Oncology, 2010, Topalian et al., NEJM, 2012). Thus, PD-L1 expression in tumours or tumour-infiltrating leukocytes (Herbst R S, et al., "Predictive correlates of response to the anti-PD-L1 antibody MPDL3280A in cancer patients", Nature, 2014, November 27, 515(7528):563-7, doi: 10.1038/nature14011) is a candidate molecular marker for use in selecting patients for immunotherapy, for example, immunotherapy using anti-PD-L1 antibodies. Patient enrichment based on surface expression of PD-L1 may significantly enhance the clinical success of treatment with drugs targeting the PD-1/PD-L1 pathway. There is also evidence of an on-going immune response, such as the tumour infiltrating $CD8^+$ T-cells, or the presence of signature of cytokine activation, such as IFNγ.

Further evidence of PD-L1 expression and correlation to disease will emerge from the numerous ongoing clinical trials. Atezolizumab is the most advanced, and recent data from Phase II trials shows therapeutic effects in metastatic urothelial carcinoma and NSCLC, particularly in patients with PD-L1$^+$ immune cells in the tumour microenvironment (see Fehrenbacher et al., 2016, The Lancet, doi.org/10.1016/S0140-6736(16)00587-0; Rosenberg et al., 2016, The Lancet, doi.org/10.1016/S0140-6736(16)00561-4). Recent results from a Phase III trial of 1225 patients with NSCLC showed improved survival in patients taking atezolizumab, compared with chemotherapy, regardless of tumour expression of PD-L1 (Rittmeyer et al., 2017, The Lancet, 389 (10066), 255-265).

SUMMARY OF THE INVENTION

Antibodies

Disclosed herein are antibodies and antigen binding fragments thereof that specifically bind to PD-L1. In one embodiment, the antibody or antigen binding fragment thereof specifically binds to surface expressed PD-L1.

In a first configuration, there is provided an antibody or a fragment thereof, that specifically binds to hPD-L1 as defined by Seq ID No:1, and competes for binding to said hPD-L1 with the antibody 1D05, wherein the antibody or fragment comprises a $V_H$ domain which comprises a CDRH3 comprising the motif $X_1GSGX_2YGX_3X_4FD$ (SEQ ID NO: 753), wherein $X_1$, $X_2$ and $X_3$ are independently any amino acid, and $X_4$ is either present or absent, and if present, may be any amino acid.

In a second configuration, there is provided an antibody or a fragment thereof which specifically binds to hPD-L1, and competes for binding to said hPD-L1 with the antibody 1D05, wherein the antibody or fragment comprises a $V_H$ domain which comprises the CDRH3 sequence of SEQ ID NO:29 or 32, or the CDRH3 sequence of SEQ ID NO:29 or 32 comprising 6 or fewer amino acid substitutions.

In a third configuration, there is provided an antibody or fragment thereof which specifically binds to an epitope that is identical to an epitope to which the antibody 1D05 specifically binds.

In a fourth configuration, there is provided an antibody or fragment thereof which competes for binding to hPD-L1 with the antibody 1D05.

In a fifth configuration, there is provided a bispecific antibody or fusion protein comprising an antibody or fragment thereof as defined in any other configuration, embodiment or concept.

In a sixth configuration, there is provided an antibody or fragment as defined in any other configuration, embodiment or concept for use in treating or preventing a hPD-L1-mediated disease or condition.

In a seventh configuration, there is provided the use of an antibody or fragment as defined in any other configuration, embodiment or concept in the manufacture of a medicament for administration to a human for treating or preventing a hPD-L1 mediated disease or condition in the human.

In an eighth configuration, there is provided a method of treating or preventing a hPD-L1 mediated disease or condition in a human, comprising administering to said human a therapeutically effective amount of an antibody or fragment as defined in any other configuration, embodiment or concept, wherein the hPD-L1 mediated disease or condition is thereby treated or prevented.

In a ninth configuration, there is provided a pharmaceutical composition comprising an antibody of fragment as defined in any other configuration, embodiment or concept and a pharmaceutically acceptable excipient, diluent or carrier.

In a tenth configuration, there is provided a kit comprising a pharmaceutical composition comprising an antibody of fragment as defined in any other configuration, embodiment or concept and a pharmaceutically acceptable excipient, diluent or carrier.

In an eleventh configuration, there is provided a method of modulating PD-1/PD-L1 interaction in a patient, comprising administering an effective amount of an antibody or fragment as defined in any other configuration, embodiment or concept to said patient.

In a twelfth configuration, there is provided a method of inhibiting PD-L1 activity in a patient, comprising administering an effective amount of an antibody or fragment as defined in any other configuration, embodiment or concept to said patient.

In a thirteenth configuration, there is provided a method of treating a proliferative disease in an animal (e.g. a human), comprising administering an effective amount of an antibody or fragment as defined in any other configuration, embodiment or concept to said patient.

In a fourteenth configuration, there is provided a method of detecting PD-L1 expression in a sample, comprising contacting the sample with an antibody or fragment as defined in any other configuration, embodiment or concept.

In a fifteenth configuration, there is provided a method comprising contacting a biological sample with an antibody or fragment as defined in any other configuration, embodiment or concept to form a complex with PD-L1 present in the sample and measuring the presence, absence or level of the complex in the biological sample.

In a sixteenth configuration, there is provided a method of detecting PD-L1 expression in a sample, comprising contacting the sample with an antibody or fragment as defined in any other configuration, embodiment or concept.

In a seventeenth configuration, there is provided a method comprising contacting a biological sample with an antibody or fragment as defined in any other configuration, embodiment or concept to form a complex with PD-L1 present in the sample and measuring the presence, absence or level of the complex in the biological sample.

In an eighteenth configuration, there is provided a method for identifying binding partners for PD-L1, the method comprising immunoprecipitating an intact protein complex comprising PD-L1 using an antibody or fragment as defined in any other configuration, embodiment or concept.

In a nineteenth configuration, there is provided a method of diagnosing a disease in a human subject associated with altered PD-L1 expression comprising the steps of contacting a biological sample from the human subject with an antibody as defined in other configuration, embodiment or concept to form a complex between the antibody and PD-L1 present in the sample; and detecting the amount of the complex.

In a twentieth configuration, there is provided a nucleic acid that encodes the CDRH3 of an antibody or fragment as defined in any other configuration, embodiment or concept.

In a twenty-first configuration, there is provided a nucleic acid that encodes a VH domain and/or a VL domain of an antibody or fragment as defined in any other configuration, embodiment or concept.

In a twenty-second configuration, there is provided a vector comprising the nucleic acid of any other configuration, embodiment or concept; optionally wherein the vector is a CHO or HEK293 vector.

In a twenty-third configuration, there is provided a host comprising the nucleic acid of any other configuration, embodiment or concept or the vector of any other configuration, embodiment or concept.

Immunocytokines

In a first configuration, there is provided an immunocytokine comprising an immunoglobulin heavy chain and an immunoglobulin light chain, wherein the heavy chain comprises in N- to C-terminal direction:
a) A $V_H$ domain comprising CDRH1, CDRH2 and CDRH3; and
b) A heavy chain constant region;
and wherein the light chain comprises in N- to C-terminal direction:
c) A $V_L$ domain comprising CDRL1, CDRL2 and CDRL3;
d) A light chain constant region, ($C_L$);
e) Optionally, a linker, (L); and
f) An IL-2 cytokine;
wherein the $V_H$ domain and $V_L$ domain are comprised by an antigen-binding site that specifically binds to hPD-L1 as defined by Seq ID No:1, and competes for binding to said hPD-L1 with the antibody 1D05; and
wherein the immunocytokine comprises a $V_H$ domain which comprises a CDRH3 comprising the motif $X_1GSGX_2YGX_3X_4FD$ (SEQ ID NO: 753), wherein $X_1$, $X_2$ and $X_3$ are independently any amino acid, and $X_4$ is either present or absent, and if present, may be any amino acid.

In a second configuration, there is provided an immunocytokine comprising an immunoglobulin heavy chain and an immunoglobulin light chain, wherein the heavy chain comprises in N- to C-terminal direction:
a) A $V_H$ domain comprising CDRH1, CDRH2 and CDRH3; and
b) A heavy chain constant region;
and wherein the light chain comprises in N- to C-terminal direction:
c) A $V_L$ domain comprising CDRL1, CDRL2 and CDRL3;
d) A light chain constant region, ($C_L$);
e) Optionally, a linker, (L); and
f) An IL-2 cytokine;
wherein the $V_H$ domain and $V_L$ domain are comprised by an antigen-binding site that specifically binds to hPD-L1, and competes for binding to said hPD-L1 with the antibody 1D05, wherein the antibody or fragment comprises a $V_H$ domain which comprises the CDRH3 sequence of SEQ ID NO:29 or 32, or the CDRH3 sequence of SEQ ID NO:29 or 32 comprising 6 or fewer amino acid substitutions.

In a third configuration, there is provided an immunocytokine comprising an immunoglobulin heavy chain and an immunoglobulin light chain, wherein the heavy chain comprises in N- to C-terminal direction:
a) A $V_H$ domain comprising CDRH1, CDRH2 and CDRH3; and
b) A heavy chain constant region;
and wherein the light chain comprises in N- to C-terminal direction:
c) A $V_L$ domain comprising CDRL1, CDRL2 and CDRL3;
d) A light chain constant region, ($C_L$);
e) Optionally, a linker, (L); and
f) An IL-2 cytokine;
wherein the $V_H$ domain and $V_L$ domain are comprised by an antigen-binding site that specifically binds to hPD-L1; and
wherein the $V_H$ domain comprises a CDRH3 of from 12 to 20 amino acids and which is derived from the recombination of a human $V_H$ gene segment, a human D gene segment and a human $J_H$ gene segment, wherein the human $J_H$ gene segment is IGHJ5 (e.g. IGHJ5*02).

In a fourth configuration, there is provided an immunocytokine comprising an immunoglobulin heavy chain and an immunoglobulin light chain, wherein the heavy chain comprises in N- to C-terminal direction:
a) A $V_H$ domain comprising CDRH1, CDRH2 and CDRH3; and
b) A heavy chain constant region;
and wherein the light chain comprises in N- to C-terminal direction:
c) A $V_L$ domain comprising CDRL1, CDRL2 and CDRL3;
d) A light chain constant region, ($C_L$);
e) Optionally, a linker, (L); and
f) An IL-2 cytokine;
wherein the $V_H$ domain and $V_L$ domain are comprised by an antigen-binding site that specifically binds to an epitope that is identical to an epitope to which the antibody 1D05 specifically binds.

In a fifth configuration, there is provided an immunocytokine comprising an immunoglobulin heavy chain and an immunoglobulin light chain, wherein the heavy chain comprises in N- to C-terminal direction:
a) A $V_H$ domain comprising CDRH1, CDRH2 and CDRH3; and
b) A heavy chain constant region;
and wherein the light chain comprises in N- to C-terminal direction:
c) A $V_L$ domain comprising CDRL1, CDRL2 and CDRL3;
d) A light chain constant region, ($C_L$);
e) Optionally, a linker, (L); and
f) An IL-2 cytokine;
wherein the $V_H$ domain and $V_L$ domain are comprised by an antigen-binding site which competes for binding to hPD-L1 with the antibody 1D05.

In a sixth configuration, there is provided an immunocytokine as defined in any other configuration, embodiment or aspect for use in treating or preventing a hPD-L1-mediated disease or condition.

In a seventh configuration, there is provided the use of an immunocytokine as defined in any other configuration, embodiment or aspect in the manufacture of a medicament for administration to a human for treating or preventing a hPD-L1 mediated disease or condition in the human.

In an eighth configuration, there is provided a method of treating or preventing a hPD-L1 mediated disease or condition in a human, comprising administering to said human a therapeutically effective amount of an immunocytokine as defined in any other configuration, embodiment or aspect, wherein the hPD-L1 mediated disease or condition is thereby treated or prevented.

In a ninth configuration, there is provided a pharmaceutical composition comprising an immunocytokine as defined in any other configuration, embodiment or aspect, and a pharmaceutically acceptable excipient, diluent or carrier.

In a tenth configuration, there is provided a kit comprising a pharmaceutical composition comprising an immunocytokine as defined in any other configuration, embodiment or aspect, and a pharmaceutically acceptable excipient, diluent or carrier.

In an eleventh configuration, there is provided a nucleic acid that encodes a heavy chain and/or a light chain of an immunocytokine as defined in any other configuration, embodiment or aspect.

In a twelfth configuration, there is provided a vector comprising the nucleic acid that encodes a heavy chain and/or a light chain of an immunocytokine as defined in any other configuration, embodiment or aspect.

In a thirteenth configuration, there is provided a host comprising the nucleic acid of any other configuration, embodiment or aspect or the vector as defined in any other configuration, embodiment or aspect.

Anti-ICOS Bispecific Antibodies

In a first configuration, there is provided a multispecific antibody (e.g. bispecific antibody or a dual-binding antibody) which binds (and optionally has specificity for) ICOS (e.g. human ICOS) and another target antigen.

In a second configuration, there is provided a composition comprising a multispecific, bispecific or dual-binding antibody as described herein and a pharmaceutically acceptable excipient, diluent or carrier.

In a third configuration, there is provided a multispecific, bispecific or dual-binding antibody as described herein for use in treating or preventing a disease or condition, selected from neurological disease, neoplastic or non-neoplastic disease, chronic viral infections, and malignant tumours; such as melanoma, Merkel cell carcinoma, non-small cell lung cancer (squamous and non-squamous), renal cell cancer, bladder cancer, head and neck squamous cell carcinoma, mesothelioma, virally induced cancers (such as cervical cancer and nasopharyngeal cancer), soft tissue sarcomas, haematological malignancies such as Hodgkin's and non-Hodgkin's disease and diffuse large B-cell lymphoma (for example melanoma, Merkel cell carcinoma, non-small cell lung cancer (squamous and non-squamous), renal cell cancer, bladder cancer, head and neck squamous cell carcinoma and mesothelioma or for example virally induced cancers (such as cervical cancer and nasopharyngeal cancer) and soft tissue sarcomas).

In a fourth configuration, there is provided a use of a multispecific, bispecific or dual-binding antibody as described herein in the manufacture of a medicament for administration to a human for treating or preventing a disease or condition in the human selected from neurological disease, neoplastic or non-neoplastic disease, chronic viral infections, and malignant tumours, such as melanoma, Merkel cell carcinoma, non-small cell lung cancer (squamous and non-squamous), renal cell cancer, bladder cancer, head and neck squamous cell carcinoma, mesothelioma, virally induced cancers (such as cervical cancer and nasopharyngeal cancer), soft tissue sarcomas, haematological malignancies such as Hodgkin's and non-Hodgkin's disease and diffuse large B-cell lymphoma (for example melanoma, Merkel cell carcinoma, non-small cell lung cancer (squamous and non-squamous), renal cell cancer, bladder cancer, head and neck squamous cell carcinoma and mesothelioma or for example virally induced cancers (such as cervical cancer and nasopharyngeal cancer) and soft tissue sarcomas).

In a fifth configuration, there is provided a method of treating or preventing a disease or condition selected from neurological disease, neoplastic or non-neoplastic disease, chronic viral infections, and malignant tumours, such as melanoma, Merkel cell carcinoma, non-small cell lung cancer (squamous and non-squamous), renal cell cancer, bladder cancer, head and neck squamous cell carcinoma, mesothelioma, virally induced cancers (such as cervical cancer and nasopharyngeal cancer), soft tissue sarcomas, haematological malignancies such as Hodgkin's and non-Hodgkin's disease and diffuse large B-cell lymphoma (for example melanoma, Merkel cell carcinoma, non-small cell lung cancer (squamous and non-squamous), renal cell cancer, bladder cancer, head and neck squamous cell carcinoma and mesothelioma or for example virally induced cancers (such as cervical cancer and nasopharyngeal cancer) and soft tissue sarcomas) in a human, comprising administering to said human a therapeutically effective amount of a multi-specific, bispecific or dual-binding antibody as described herein, wherein the disease or condition is thereby treated or prevented.

In a sixth configuration, there is provided a nucleic acid that encodes a heavy chain and/or a light chain of a multi-specific antibody as described herein.

In a seventh configuration, there is provided a vector comprising the nucleic acid that encodes a heavy chain and/or a light chain of a multispecific antibody as described herein.

Anti-TIGIT Antibodies, Fragments & Immunocytokines

In a first configuration, there is provided an antibody or fragment which specifically binds to TIGIT (T cell immunoreceptor with Ig and ITIM domains) and comprises a $V_H$ domain which comprises a CDRH3 sequence selected from
  (a) SEQ ID NO: 599, 602, 619, 622, 639, 642, 659, 662 or said selected CDRH3 sequence comprising 3, 2 or 1 amino acid substitution(s); or
  (b) the CDRH3 sequence of an antibody selected from the group consisting of KY01-KY23, or wherein the CDRH3 sequence of said $V_H$ domain comprises 3, 2 or 1 amino acid substitution(s) compared to the CDRH3 sequence of an antibody selected from the group consisting of KY01-KY23.

In a second configuration, there is provided an antibody or fragment (optionally according to any preceding Statement), comprising one or more TIGIT binding sites, wherein each binding site specifically binds to TIGIT and comprises a VH domain and a VL domain, wherein
  (a) The VH domain is according to Statement 4(ix) and the VL domain is according to Statement 9(XIII);
  (b) The VH domain is according to Statement 4(x) and the VL domain is according to Statement 9(XIV);
  (c) The VH domain is according to Statement 4(xi) and the VL domain is according to Statement 9(XV);
  (d) The VH domain is according to Statement 4(xii) and the VL domain is according to Statement 9(XVI);
  Wherein Statements 4 and 9 are discussed further below.

In a third configuration, there is provided
An anti-TIGIT antibody or fragment thereof which specifically binds to an epitope that is identical to an epitope to which the antibody KY01 specifically binds.
An anti-TIGIT antibody or fragment thereof which specifically binds to an epitope that is identical to an epitope to which the antibody KY02 specifically binds.
An anti-TIGIT antibody or fragment thereof which specifically binds to an epitope that is identical to an epitope to which the antibody KY03 specifically binds.
An anti-TIGIT antibody or fragment thereof which specifically binds to an epitope that is identical to an epitope to which the antibody KY04 specifically binds.
An anti-TIGIT antibody or fragment which competes for binding to human TIGIT with the antibody KY01.
An anti-TIGIT antibody or fragment which competes for binding to human TIGIT with the antibody KY02.
An anti-TIGIT antibody or fragment which competes for binding to human TIGIT with the antibody KY03.
An anti-TIGIT antibody or fragment which competes for binding to human TIGIT with the antibody KY04.

In a fourth configuration, there is provided an antibody or fragment thereof which competes for binding to human TIGIT with an anti-TIGIT antibody of the invention (such as any one of KY01-KY23), eg, as determined by SPR.

In a fifth configuration, there is provided an antibody or a fragment thereof which comprises a binding site comprising a VH domain and a VL domain, wherein the binding site specifically binds TIGIT, and wherein
  a) the VH domain is encoded by a nucleotide sequence that is derived from the recombination of a human VH gene segment, DH gene segment and JH gene segment, wherein the VH gene segment is selected from IGHV3-11, IGHV3-15, IGHV3-20, IGHV3-9 and IGHV4-4; and
  b) the VL domain is encoded by a nucleotide sequence that is derived from the recombination of a human VL gene segment and JL gene segment, wherein the VL gene segment is selected from IGKV1-39, IGKV1D-39, IGKV1-5, IGLV3-1, IGKV2-28 and IGLV3-10.

In a sixth configuration, there is provided an anti-TIGIT immunocytokine (ICK) comprising an immunoglobulin heavy and an optional light chain, wherein immunocytokine comprises an antibody binding site that specifically binds TIGIT and optionally comprises a VH domain of the heavy chain, the VH domain being according to the invention.

In a seventh configuration, there is provided the antibody, fragment or immunocytokine according to the invention for treating a cancer in a human or animal subject by
  a. inhibiting the binding of TIGIT to CD155 in a tumour microenvironment;
  b. inhibiting P-Tyr and/or NFkβ signalling in TIGIT⁺ T- and/or NK cells;
  c. inhibiting tumour cell-mediated (eg, PD-L1-positive tumour cell-mediated) suppression of T- and/or NK cells in a tumour microenvironment of the cancer in a subject (eg, a human) suffering from the cancer; and/or
  d. reducing TIGIT-mediated inhibition of one or more T-cell factors in a tumour microenvironment of said cancer, wherein each factor is selected from T-bet, GATA3, IFN regulatory factor (IFR)4, RORc, IL-2 and IFN-γ.

In a eighth configuration, there is provided the antibody, fragment or immunocytokine according to the invention for treating or preventing a TIGIT-mediated disease or condition, e.g. selected from neoplastic or non-neoplastic disease, chronic viral infections, and malignant tumours, such as melanoma, Merkel cell carcinoma, non-small cell lung cancer (squamous and non-squamous), renal cell cancer, bladder cancer, head and neck squamous cell carcinoma, mesothelioma, virally induced cancers (such as cervical cancer and nasopharyngeal cancer), soft tissue sarcomas, haematological malignancies such as Hodgkin's and non-Hodgkin's disease and diffuse large B-cell lymphoma (for example melanoma, Merkel cell carcinoma, non-small cell lung cancer (squamous and non-squamous), renal cell cancer, bladder cancer, head and neck squamous cell carcinoma and mesothelioma or for example virally induced cancers (such as cervical cancer and nasopharyngeal cancer) and soft tissue sarcomas). A corresponding use and method is also provided.

The invention further provides pharmaceutical compositions, nucleic acids, vectors and host cells.

DESCRIPTION OF THE FIGURES

FIG. 14(a): shows the group mean (n=8/9) tumour growth curve, for this graph when an animal is removed from the study due to tumour size, the last reading is used for the rest of the study. The shaded area shows the area where the last reading is being used FIGS. 14(b) to (e): show the individual animal tumour growth curves for each group. (b) A375 tumours alone; (c) A375 tumours co-injected with CD4+/8+ T-cells at a 6:1 ratio. For panels (d) and (e) A375 tumour cell were co-injected with CD4+/8+ T-cells at a 6:1 ratio; (d) Isotype Control antibody at 10 mg/kg and (e) anti-PD-L1 antibody 1D05 at 10 mg/kg. Dosing was at 1-hour post tumour/T-cell implantation and on days 3, 6, 8 and 10, shown on the graph by the dotted lines

DETAILED DESCRIPTION

1. Definitions

Figure 1:
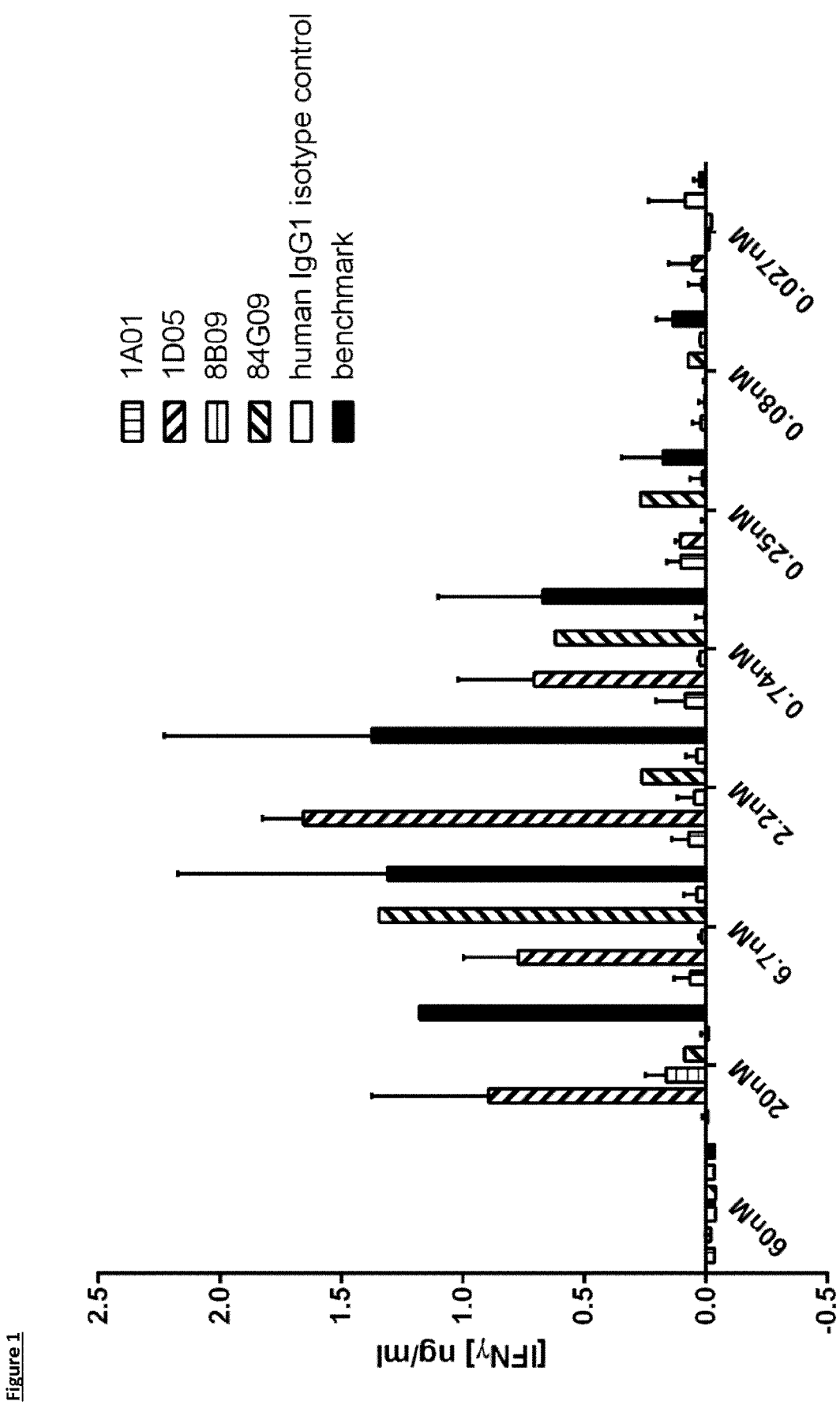
FIG. 1: Analysis of selected antibodies in a dendritic cell-T-cell mixed lymphocyte reaction. Monocytes were cultured with GM-CSF and IL-4 for seven days, before addition of allogeneic purified CD3+ T-cells and titrations of antibodies. Supernatants were taken at day 5 for analysis of IFNγ production. Data is shown from one experiment. Note that for 84G09, there is a single point per concentration, as one replicate failed

Disclosures in this Definitions expressed in terms of PD-L1 and anti-PD-L1 antibodies and fragments apply mutatis mutandis to the invention herein as it relates to TIGIT, ICOS and anti-TIGIT or anti-ICOS antibodies and fragments.

Unless otherwise defined herein, scientific and technical terms shall have the meanings that are commonly understood by those of ordinary skill in the art. Further, unless otherwise required by context, singular terms shall include pluralities and plural terms shall include the singular.

The singular terms "a," "an," and "the" include plural referents unless context clearly indicates otherwise. Similarly, the word "or" is intended to include "and" unless the context clearly indicates otherwise. Although methods and materials similar or equivalent to those described herein can be used in the practice or testing of this disclosure, suitable methods and materials are described below. The abbreviation, "e.g." is derived from the Latin exempli gratia, and is used herein to indicate a non-limiting example. Thus, the abbreviation "e.g." is synonymous with the term "for example."

In the specification and claims, the term "about" is used to modify, for example, the quantity of an ingredient in a composition, concentration, volume, process temperature, process time, yield, flow rate, pressure, and like values, and ranges thereof, employed in describing the embodiments of the disclosure. The term "about" refers to variation in the numerical quantity that can occur, for example, through typical measuring and handling procedures used for making compounds, compositions, concentrates or use formulations; through inadvertent error in these procedures; through differences in the manufacture, source, or purity of starting materials or ingredients used to carry out the methods, and like proximate considerations. The term "about" also encompasses amounts that differ due to aging of a formulation with a particular initial concentration or mixture, and amounts that differ due to mixing or processing a formulation with a particular initial concentration or mixture. Where modified by the term "about" the claims appended hereto include equivalents to these quantities.

As used herein, "administer" or "administration" refers to the act of injecting or otherwise physically delivering a substance as it exists outside the body (e.g., an anti-hPD-L1 antibody provided herein) into a patient, such as by mucosal, intradermal, intravenous, intramuscular delivery and/or any other method of physical delivery described herein or known in the art. When a disease, or a symptom thereof, is being treated, administration of the substance typically occurs after the onset of the disease or symptoms thereof. When a disease, or symptoms thereof, are being prevented, administration of the substance typically occurs before the onset of the disease or symptoms thereof.

The term "antibody", "immunoglobulin" or "Ig" may be used interchangeably herein and means an immunoglobulin molecule that recognizes and specifically binds to a target, such as a protein, polypeptide, peptide, carbohydrate, polynucleotide, lipid, or combinations of the foregoing through at least one antigen recognition site within the variable region of the immunoglobulin molecule. As used herein, the term "antibody" encompasses intact polyclonal antibodies, intact monoclonal antibodies, antibody fragments (such as Fab, Fab', F(ab')$_2$, and Fv fragments), single chain Fv (scFv) mutants, multispecific antibodies such as bispecific antibodies (including dual binding antibodies), chimeric antibodies, humanized antibodies, human antibodies, fusion proteins comprising an antigen determination portion of an antibody, and any other modified immunoglobulin molecule comprising an antigen recognition site so long as the antibodies exhibit the desired biological activity. The term "antibody" can also refer to a Y-shaped glycoprotein with a molecular weight of approximately 150 kDa that is made up of four polypeptide chains: two light (L) chains and two heavy (H) chains. There are five types of mammalian Ig heavy chain isotypes denoted by the Greek letters alpha (α), delta (δ), epsilon (ε), gamma (γ), and mu (μ). The type of heavy chain defines the class of antibody, i.e., IgA, IgD, IgE, IgG, and IgM, respectively. The γ and α classes are further divided into subclasses on the basis of differences in the constant domain sequence and function, e.g., IgG1, hIgG2, mIgG2A, mIgG2B, IgG3, IgG4, IgA1 and IgA2. In mammals, there are two types of immunoglobulin light chains, λ and κ. The "variable region" or "variable domain" of an antibody refers to the amino-terminal domains of the heavy or light chain of the antibody. The variable domains of the heavy chain and light chain may be referred to as "$V_H$" and "$V_L$", respectively. These domains are generally the most variable parts of the antibody (relative to other antibodies of the same class) and contain the antigen binding sites. An example of antibodies are heavy chain-only (ie, H2) antibodies that comprise a dimer of a heavy chain (5'-VH-(optional Hinge)-CH2-CH3-3') and are devoid of a light chain.

The antibodies described herein may be oligoclonal, polyclonal, monoclonal (including full-length monoclonal antibodies), camelised, chimeric, CDR-grafted, multi-specific, bi-specific (including dual-binding antibodies), catalytic, chimeric, humanized, fully human, anti-idiotypic, including antibodies that can be labelled in soluble or bound form as well as fragments, variants or derivatives thereof, either alone or in combination with other amino acid sequences provided by known techniques. An antibody may be from any species. Antibodies described herein can be naked or conjugated to other molecules such as toxins, radioisotopes, etc.

The term "antigen binding domain," "antigen binding region," "antigen binding fragment," and similar terms refer to that portion of an antibody which comprises the amino acid residues that interact with an antigen and confer on the binding agent its specificity and affinity for the antigen (e.g. the complementarity determining regions (CDRs)). The antigen binding region can be derived from any animal species, such as rodents (e.g. rabbit, rat or hamster) and humans. Preferably, the antigen binding region will be of human origin.

Antigen binding fragments described herein can include single-chain Fvs (scFv), single-chain antibodies, single domain antibodies, domain antibodies, Fv fragments, Fab fragments, F(ab') fragments, F(ab')$_2$ fragments, antibody fragments that exhibit the desired biological activity, disulfide-stabilised variable region (dsFv), dimeric variable region (diabody), anti-idiotypic (anti-Id) antibodies (including, e.g. anti-Id antibodies to antibodies), intrabodies, linear antibodies, single-chain antibody molecules and multispecific antibodies formed from antibody fragments and epitope-binding fragments of any of the above. In particular, antibodies and antibody fragments described herein can include immunoglobulin molecules and immunologically active fragments of immunoglobulin molecules, i.e., molecules that contain an antigen-binding site. Digestion of antibodies with the enzyme, papain, results in two identical antigen-binding fragments, known also as "Fab" fragments, and a "Fc" fragment, having no antigen-binding activity but having the ability to crystallize. "Fab" when used herein refers to a fragment of an antibody that includes one constant and one variable domain of each of the heavy and light chains. The term "Fc region" herein is used to define a C-terminal region of an immunoglobulin heavy chain, including native-sequence Fc regions and variant Fc regions. The "Fc fragment" refers to the carboxy-terminal portions of both H chains held together by disulfides. The effector functions of antibodies are determined by sequences in the Fc region, the region which is also recognized by Fc receptors (FcR) found on certain types of cells. Digestion of antibodies with the enzyme, pepsin, results in a F(ab')$_2$ fragment in which the two arms of the antibody molecule remain linked and comprise two-antigen binding sites. The F(ab')$_2$ fragment has the ability to crosslink antigen.

"Fv" when used herein refers to the minimum fragment of an antibody that retains both antigen-recognition and antigen-binding sites. This region consists of a dimer of one heavy and one light chain variable domain in tight, non-covalent or covalent association. It is in this configuration that the three CDRs of each variable domain interact to define an antigen-binding site on the surface of the $V_H$-$V_L$ dimer. Collectively, the six CDRs confer antigen-binding specificity to the antibody. However, even a single variable domain (or half of an Fv comprising only three CDRs specific for an antigen) has the ability to recognize and bind antigen, although at a lower affinity than the entire binding site.

The term "monoclonal antibody" as used herein refers to an antibody obtained from a population of substantially homogeneous antibodies, i.e. the individual antibodies comprising the population are identical except for possible naturally occurring mutations and/or post-translation modifications (e.g. isomerizations, amidations) that may be present in minor amounts. Monoclonal antibodies are highly specific, and are directed against a single antigentic determinant or epitope. In contrast, polyclonal antibody preparations typically include different antibodies directed against different antigenic determinants (or epitopes). The term "monoclonal antibody" as used herein encompasses both intact and full-length monoclonal antibodies as well as antibody fragments (such as Fab, Fab', F(ab')$_2$, Fv), single chain (scFv) mutants, fusion proteins comprising an antibody portion, and any other modified immunoglobulin molecule comprising an antigen recognition site. Furthermore, "monoclonal antibody" refers to such antibodies made in any number of ways including, but not limited to, hybridoma, phage selection, recombinant expression, and transgenic animals.

The monoclonal antibodies herein can include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is(are) identical with or homologous to corresponding sequences in antibodies derived from another species or belonging to another antibody class or subclass, as well as fragments of such antibodies that exhibit the desired biological activity.

The term "humanized antibody" refers to a subset of chimeric antibodies in which a "hypervariable region" from a non-human immunoglobulin (the donor antibody) replaces residues from a hypervariable region in a human immunoglobulin (recipient antibody). In general, a humanized antibody will include substantially all of at least one, and typically two, variable domains, in which all or substantially all of the hypervariable loops correspond to those of a non-human immunoglobulin sequence, and all or substantially all of the framework regions are those of a human immunoglobulin sequence, although the framework regions may include one or more substitutions that improve antibody performance, such as binding affinity, isomerization, immunogenicity, etc.

The term "bispecific antibody" means an antibody which comprises specificity for two target molecules, and includes, but is not limited to, formats such as DVD-Ig (see DiGiammarino et al., "Design and generation of DVD-Ig™ molecules for dual-specific targeting", Meth. Mo. Biol., 2012, 889, 145-156), mAb$^2$ (see WO2008/003103, the description of the mAb$^2$ format is incorporated herein by reference), FIT-Ig (see WO2015/103072, the description of the FIT-Ig scaffold is incorporated herein by reference), mAb-dAb, dock and lock, Fab-arm exchange, SEEDbody, Triomab, LUZ-Y, Fcab, κλ-body, orthogonal Fab, scDiabody-Fc, diabody-Fc, tandem scFv-Fc, Fab-scFv-Fc, Fab-scFv, intrabody, BiTE, diabody, DART, TandAb, scDiabody, scDiabody-CH3, Diabody-CH3, Triple body, Miniantibody, minibody, TriBi minibody, scFv-CH3 KIH, scFv-CH-CL-scFv, F(ab')2-scFv, scFv-KIH, Fab-scFv-Fc, tetravalent HCab, ImmTAC, knobs-in-holes, knobs-in-holes with common light chain, knobs-in-holes with common light chain and charge pairs, charge pairs, charge pairs with common light chain, DT-IgG, DutaMab, IgG(H)-scFv, scFv-(H)IgG, IgG(L)-scFv, scFv-(L)IgG, IgG(L,H)-Fv, IgG(H)-V, V(H)-IgG, IgG(L)-V, V(L)-IgG, KIH IgG-scFab, 2scFv-IgG, IgG-2scFv, scFv4-Ig and zybody. For a review of bispecific formats, see Spiess, C., et al., Mol. Immunol. (2015). In another embodiment, the bispecific molecule comprises an antibody which is fused to another non-Ig format, for example a T-cell receptor binding domain; an immunoglobulin superfamily domain; an agnathan variable lymphocyte receptor; a fibronectin domain (e.g. an Adnectin™); an antibody constant domain (e.g. a $CH_3$ domain, e.g., a $CH_2$ and/or $CH_3$ of an Fcab™) wherein the constant domain is not a functional $CH_1$ domain; an scFv; an (scFv)$_2$; an sc-diabody; an scFab; a centyrin and an epitope binding domain derived from a scaffold selected from CTLA-4 (Evibody™); a lipocalin domain; Protein A such as Z-domain of Protein A (e.g. an Affibody™ or SpA); an A-domain (e.g. an Avimer™ or Maxibody™); a heat shock protein (such as and epitope binding domain derived from GroEI and GroES); a transferrin domain (e.g. a trans-body); ankyrin repeat protein (e.g. a DARPin™); peptide aptamer; C-type lectin domain (e.g. Tetranectin™); human γ-crystallin or human ubiquitin (an affilin); a PDZ domain; scorpion toxin; and a kunitz type domain of a human protease inhibitor.

In one embodiment, the bispecific antibody is a mAb$^2$. A mAb$^2$ comprises a $V_H$ and $V_L$ domain from an intact antibody, fused to a modified constant region, which has been engineered to form an antigen-binding site, known as an "Fcab". The technology behind the Fcab/mAb$^2$ format is described in more detail in WO2008/003103, and the description of the mAb$^2$ format is incorporated herein by reference.

In one embodiment, a "bispecific antibody" does not include a FIT-Ig format. In one embodiment, a "bispecific antibody" does not include a mAb$^2$ format. In one embodiment, a "bispecific antibody" does not include either a FIT-Ig format or a mAb$^2$ format.

In another embodiment, the bispecific antibody is a "dual binding antibody". As used herein, the term "dual binding antibody" is a bispecific antibody wherein both antigen-binding domains are formed by a $V_H/V_L$ pair, and includes FIT-Ig (see WO2015/103072, incorporated herein by reference), mAb-dAb, dock and lock, Fab-arm exchange, SEEDbody, Triomab, LUZ-Y, Fcab, κλ-body, orthogonal Fab, scDiabody-Fc, diabody-Fc, tandem scFv-Fc, Fab-scFv-Fc, Fab-scFv, intrabody, BiTE, diabody, DART, TandAb, scDiabody, scDiabody-CH3, Diabody-CH3, Triple body, Miniantibody, minibody, scFv-CH$_3$ KIH, scFv-CH-CL-scFv, F(ab')$_2$-scFv, scFv-KIH, Fab-scFv-Fc, tetravalent HCab, ImmTAC, knobs-in-holes, knobs-in-holes with common light chain, knobs-in-holes with common light chain and charge pairs, charge pairs, charge pairs with common light chain, DT-IgG, DutaMab, IgG(H)-scFv, scFv-(H)IgG, IgG(L)-scFv, scFv-(L)IgG, IgG(L,H)-Fv, IgG(H)-V, V(H)-IgG, IgG(L)-V, V(L)-IgG, KIH IgG-scFab, 2scFv-IgG, IgG-2scFv and scFv4-Ig.

The term "hypervariable region", "CDR region" or "CDR" refers to the regions of an antibody variable domain which are hypervariable in sequence and/or form structurally defined loops. Generally, antigen binding sites of an antibody include six hypervariable regions: three in the $V_H$ (CDRH1, CDRH2, CDRH3), and three in the $V_L$ (CDRL1, CDRL2, CDRL3). These regions of the heavy and light chains of an antibody confer antigen-binding specificity to the antibody. CDRs may be defined according to the Kabat system (see Kabat, E. A. et al., 1991, "Sequences of Proteins of Immunological Interest", 5$^{th}$ edit., NIH Publication no. 91-3242, U.S. Department of Health and Human Services). Other systems may be used to define CDRs, which as the system devised by Chothia eta/(see Chothia, C. & Lesk, A. M., 1987, "Canonical structures for the hypervariable regions of immunoglobulins", J. Mol. Biol., 196, 901-917) and the IMGT system (see Lefranc, M. P., 1997, "Unique database numbering system for immunogenetic analysis", Immunol. Today, 18, 50). An antibody typically contains 3 heavy chain CDRs and 3 light chain CDRs. The term CDR or CDRs is used here to indicate one or several of these regions. A person skilled in the art is able to readily compare the different systems of nomenclature and determine whether a particular sequence may be defined as a CDR.

A "human antibody" is an antibody that possesses an amino-acid sequence corresponding to that of an antibody produced by a human and/or has been made using any of the techniques for making human antibodies and specifically excludes a humanized antibody comprising non-human antigen-binding residues. The term "specifically binds to" refers to measurable and reproducible interactions such as binding between a target and an antibody, which is determinative of the presence of the target in the presence of a heterogeneous population of molecules including biological molecules. For example, an antibody that specifically binds to a target (which can be an epitope) is an antibody that binds this target with greater affinity, avidity, more readily, and/or with greater duration than it binds to other targets. In one embodiment, the extent of binding of an antibody to an unrelated target is less than about 10% of the binding of the antibody to the target as measured, e.g. by a radioimmunoassay (RIA).

An antibody or a fragment thereof that specifically binds to a hPD-L1 antigen may be cross-reactive with related antigens. Preferably, an antibody or a fragment thereof that specifically binds to a hPD-L1 antigen does not cross-react with other antigens (but may optionally cross-react with PD-L1 of a different species, e.g. rhesus, or murine). An antibody or a fragment thereof that specifically binds to a hPD-L1 antigen can be identified, for example, by immunoassays, BIAcore™, or other techniques known to those of skill in the art. An antibody or a fragment thereof binds specifically to a PD-L1 antigen when it binds to a hPD-L1 antigen with higher affinity than to any cross-reactive antigen as determined using experimental techniques, such as radioimmunoassays (RIA) and enzyme-linked immunosorbent assays (ELISAs). Typically, a specific or selective reaction will be at least twice background signal or noise and more typically more than 10 times (such as more than 15 times, more than 20 times, more than 50 times or more than 100 times) background. See, e.g. Paul, ed., 1989, Fundamental Immunology Second Edition, Raven Press, New York at pages 332-336 for a discussion regarding antibody specificity.

The term "aliphatic amino acid" means that the amino acid R groups are nonpolar and hydrophobic. Hydrophobicity increases with increasing number of C atoms in the hydrocarbon chain. Glycine, Alanine, Valine, Leucine and Isoleucine are aliphatic amino acids.

The term "aromatic amino acid" means that the amino acid R groups contain an aromatic ring system. Phenylalanine, Tyrosine and Tryptophan are aromatic amino acids.

The term "hydroxyl-containing amino acid" means that the amino acid R groups contain a hydroxyl group, and are hydrophilic. Serine, Cysteine, Threonine and Methionine are hydroxyl-containing amino acids.

The term "basic amino acid" means that the amino acid R groups are nitrogen containing and are basic at neutral pH. Histidine, Lysine and Arginine are basic amino acids.

The term "cyclic amino acid" means that the amino acid R groups have an aliphatic cyclic structure. Proline is the only cyclic aliphatic amino acid.

The term "acidic amino acid" means that the amino acid R groups are polar and are negatively charged at physiological pH. Aspartate and Glutamate are acidic amino acids.

The term "amide amino acid" means that the amino acid R groups contain an amide group. Asparagine and Glutamine are amide amino acids.

As used herein, "authorization number" or "marketing authorization number" refers to a number issued by a regulatory agency upon that agency determining that a particular medical product and/or composition may be marketed and/or offered for sale in the area under the agency's jurisdiction. As used herein "regulatory agency" refers to one of the agencies responsible for evaluating, e.g. the safety and efficacy of a medical product and/or composition and controlling the sales/marketing of such products and/or compositions in a given area. The Food and Drug Administration (FDA) in the US and the European Medicines Agency (EPA) in Europe are but two examples of such regulatory agencies. Other non-limiting examples can include SDA, MPA, MHPRA, IMA, ANMAT, Hong Kong Department of Health-Drug Office, CDSCO, Medsafe, and KFDA.

As used herein, the term "biomarker" refers to a gene that is differentially expressed in individuals having a disease of interest, for example, a gene that is differentially expressed in individuals having cancer. In one embodiment, PD-L1 is a biomarker whose expression in tumours may be indicative as to whether or not a patient would respond to a particular type of treatment, in particular, whether a patient would response to treatment targeting PD-L1, for example, immunotherapy using anti-PD-L1 antibodies. In one embodiment, PD-L1 is a biomarker whose expression in tumours may be indicative as to whether or not a patient would respond to a particular type of treatment, in particular, whether a patient would response to treatment targeting PD-1, for example, immunotherapy using anti-PD-1 antibodies. In another embodiment, PD-L1 may be free or membrane bound. In another embodiment, PD-L1 may be fixed or unfixed.

As used herein, a "buffer" refers to a chemical agent that is able to absorb a certain quantity of acid or base without undergoing a strong variation in pH.

As used herein, the term "carrier" refers to a diluent, adjuvant (e.g., Freund's adjuvant (complete and incomplete)), excipient, or vehicle with which the therapeutic is administered. Such pharmaceutical carriers can be sterile liquids, such as water and oils, including those of petroleum, animal, vegetable or synthetic origin, such as peanut oil, soybean oil, mineral oil, sesame oil and the like. Water is a preferred carrier when the pharmaceutical composition is administered intravenously. Saline solutions and aqueous dextrose and glycerol solutions can also be employed as liquid carriers, particularly for injectable solutions.

The term "chemotherapeutic agent" or "chemotherapy" refers to a therapeutic agent whose primary purpose is to destroy cancer cells, typically by interfering with the tumour cell's ability to grow or multiply. There are many different types of chemotherapeutic agents, with more than 50 approved chemotherapy drugs available. Chemotherapeutic drugs can be classified based on how they work. Alkylating drugs kill cancer cells by directly attacking DNA, the genetic material of the genes. Cyclophosphamide is an alkylating drug. Antimetabolites interfere with the production of DNA and keep cells from growing and multiplying. An example of an antimetabolite is 5-fluorouracil (5-FU). Anti-tumour antibiotics are made from natural substances such as fungi in the soil. They interfere with important cell functions, including production of DNA and cell proteins. Doxorubicin and bleomycin belong to this group of chemotherapy drugs. Plant alkaloids prevent cells from dividing normally. Vinblastine and vincristine are plant alkaloids obtained from the periwinkle plant. Steroid hormones slow the growth of some cancers that depend on hormones. For example, tamoxifen is used to treat breast cancers that depend on the hormone estrogen for growth. DNA damage response (DDR) inhibitors, such as PARP inhibitors, block DNA repair mechanisms following single or double stranded breaks.

Examples of chemotherapeutic agents include Adriamycin, Doxorubicin, 5-Fluorouracil, Cytosine arabinoside (Ara-C), Cyclophosphamide, Thiotepa, Taxotere (docetaxel), Busulfan, Cytoxin, Taxol, Methotrexate, Cisplatin, Melphalan, Vinblastine, Bleomycin, Etoposide, Ifosfamide, Mitomycin C, Mitoxantrone, Vincreistine, Vinorelbine, Carboplatin, Teniposide, Daunomycin, Carminomycin, Aminopterin, Dactinomycin, Mitomycins, Esperamicins (see, U.S. Pat. No. 4,675,187), Melphalan, and other related nitrogen mustards. Suitable toxins and chemotherapeutic agents are described in Remington's Pharmaceutical Sciences, 19th Ed. (Mack Publishing Co. 1995), and in Goodman and Gilman's The Pharmacological Basis of Therapeutics, $7^{th}$ Ed. (MacMillan Publishing Co. 1985). Another example of chemotherapeutic agents is the class of antibody-conjugated toxins, including, but not limited to pyrrolobenzodiazepiness, maytansanoids, calicheamicin, etc. Other suitable toxins and/or chemotherapeutic agents are known to those of skill in the art.

As used herein, the term "composition" is intended to encompass a product containing the specified ingredients (e.g. an antibody of the invention) in, optionally, the specified amounts, as well as any product which results, directly or indirectly, from combination of the specified ingredients in, optionally, the specified amounts.

As used herein the term "comprising" or "comprises" is used with reference to antibodies, fragments, uses, compositions, methods, and respective component(s) thereof, that are essential to the method or composition, yet open to the inclusion of unspecified elements, whether essential or not.

The term "consisting of" refers to antibodies, fragments, uses, compositions, methods, and respective components thereof as described herein, which are exclusive of any element not recited in that description of the embodiment.

As used herein the term "consisting essentially of" refers to those elements required for a given embodiment. The term permits the presence of elements that do not materially affect the basic and novel or functional characteristic(s) of that embodiment.

In the context of a polypeptide, the term "derivative" as used herein refers to a polypeptide that comprises an amino acid sequence of a hPD-L1 polypeptide, a fragment of a hPD-L1 polypeptide, or an antibody that specifically binds to a hPD-L1 polypeptide which has been altered by the introduction of amino acid residue substitutions, deletions or additions. The term "derivative" as used herein also refers to a hPD-L1 polypeptide, a fragment of a hPD-L1 polypeptide, or an antibody that specifically binds to a hPD-L1 polypeptide which has been chemically modified, e.g. by the covalent attachment of any type of molecule to the polypeptide. For example, but not by way of limitation, a hPD-L1 polypeptide, a fragment of a hPD-L1 polypeptide, or a hPD-L1 antibody may be chemically modified, e.g. by glycosylation, acetylation, pegylation, phosphorylation, amidation, derivatization by known protecting/blocking groups, proteolytic cleavage, linkage to a cellular ligand or other protein, etc. The derivatives are modified in a manner that is different from naturally occurring or starting peptide or polypeptides, either in the type or location of the molecules attached. Derivatives further include deletion of one or more chemical groups which are naturally present on the peptide or polypeptide. A derivative of a hPD-L1 polypeptide, a fragment of a hPD-L1 polypeptide, or a hPD-L1 antibody may be chemically modified by chemical modifications using techniques known to those of skill in the art, including, but not limited to specific chemical cleavage, acetylation, formulation, metabolic synthesis of tunicamycin, etc. Further, a derivative of a hPD-L1 polypeptide, a fragment of a hPD-L1 polypeptide, or a hPD-L1 antibody may contain one or more non-classical amino acids. A polypeptide derivative possesses a similar or identical function as a hPD-L1 polypeptide, a fragment of a hPD-L1 polypeptide, or a hPD-L1 antibody described herein.

The term "effector function" as used herein is meant to refer to one or more of antibody dependant cell mediated cytotoxic activity (ADCC), complement-dependant cytotoxic activity (CDC) mediated responses, Fc-mediated phagocytosis or antibody dependant cellular phagocytosis (ADCP) and antibody recycling via the FcRn receptor.

An "effective amount" refers to an amount effective, at dosages and for periods of time necessary, to achieve the desired effect, including a therapeutic or prophylactic result. A "therapeutically effective amount" refers to the minimum concentration required to effect a measurable improvement or prevention of a particular disorder. A therapeutically effective amount herein may vary according to factors such as the disease state, age, sex, and weight of the patient, and the ability of the antibody to elicit a desired response in the individual. A therapeutically effective amount is also one in which toxic or detrimental effects of the antibody are outweighed by the therapeutically beneficial effects. A "prophylactically effective amount" refers to an amount effective, at the dosages and for periods of time necessary, to achieve the desired prophylactic result. In some embodiments, the effective amount of an antibody of the invention is from about 0.1 mg/kg (mg of antibody per kg weight of the subject) to about 100 mg/kg. In certain embodiments, an effective amount of an antibody provided therein is about 0.1 mg/kg, about 0.5 mg/kg, about 1 mg/kg, 3 mg/kg, 5 mg/kg, about 10 mg/kg, about 15 mg/kg, about 20 mg/kg, about 25 mg/kg, about 30 mg/kg, about 35 mg/kg, about 40 mg/kg, about 45 mg/kg, about 50 mg/kg, about 60 mg/kg, about 70 mg/kg, about 80 mg/kg about 90 mg/kg or about 100 mg/kg (or a range therein). In some embodiments, "effective amount" as used herein also refers to the amount of an antibody of the invention to achieve a specified result (e.g. inhibition of a hPD-L1 biological activity of a cell).

The term "epitope" as used herein refers to a localized region on the surface of an antigen, such as hPD-L1 polypeptide or hPD-L1 polypeptide fragment, that is capable of being bound to one or more antigen binding regions of an antibody, and that has antigenic or immunogenic activity in an animal, preferably a mammal, and most preferably in a human, that is capable of eliciting an immune response. An epitope having immunogenic activity is a portion of a polypeptide that elicits an antibody response in an animal. An epitope having antigenic activity is a portion of a polypeptide to which an antibody specifically binds as determined by any method well known in the art, for example, by the immunoassays described herein. Antigenic epitopes need not necessarily be immunogenic. Epitopes usually consist of chemically active surface groupings of molecules such as amino acids or sugar side chains and have specific three dimensional structural characteristics as well as specific charge characteristics. A region of a polypeptide contributing to an epitope may be contiguous amino acids of the polypeptide or the epitope may come together from two or more non-contiguous regions of the polypeptide. The epitope may or may not be a three-dimensional surface feature of the antigen. In certain embodiments, a hPD-L1 epitope is a three-dimensional surface feature of a hPD-L1 polypeptide (e.g. in a trimeric form of a hPD-L1 polypeptide). In other embodiments, a hPD-L1 epitope is linear feature of a hPD-L1 polypeptide (e.g. in a trimeric form or monomeric form of the hPD-L1 polypeptide). Antibodies provided herein may specifically bind to an epitope of the monomeric (denatured) form of hPD-L1, an epitope of the trimeric (native) form of hPD-L1, or both the monomeric (denatured) form and the trimeric (native) form of hPD-L1. In specific embodiments, the antibodies provided herein specifically bind to an epitope of the trimeric form of hPD-L1 but do not specifically bind the monomeric form of hPD-L1.

The term "excipients" as used herein refers to inert substances which are commonly used as a diluent, vehicle, preservatives, binders, or stabilizing agent for drugs and includes, but not limited to, proteins (e.g. serum albumin, etc.), amino acids (e.g. aspartic acid, glutamic acid, lysine, arginine, glycine, histidine, etc.), fatty acids and phospholipids (e.g. alkyl sulfonates, caprylate, etc.), surfactants (e.g. SDS, polysorbate, nonionic surfactant, etc.), saccharides (e.g. sucrose, maltose, trehalose, etc.) and polyols (e.g. mannitol, sorbitol, etc.). See, also, Remington's Pharmaceutical Sciences (1990) Mack Publishing Co., Easton, Pa., which is hereby incorporated by reference in its entirety.

As used herein, the term "fixed" or "fixation" refers to a chemical process by which biological tissues are preserved from decay, to prevent autolysis or putrefaction. In general, fixation involves exposing the tissue to chemical compounds such as alcohols or aldehydes such as formaldehyde to terminate ongoing biochemical reactions. In some instances, fixation may also increase the mechanical strength or stability of the treated tissues. The term "unfixed" refers to a tissue that has not been subjected to a chemical process to prevent tissue decay. As used herein, the term "surface expressed" means that the protein is embedded in or spans a cell membrane or is associated with a protein that is embedded in or spans a cell membrane (i.e. a membrane associated protein). In one embodiment, a surface expressed protein includes one or more transmembrane domains. In another embodiment, the protein is associated with the exterior or interior surface of a cell membrane indirectly via association with another membrane spanning protein (i.e. the surface expressed protein is not spanning the cell membrane itself). In general, surface expressed proteins that are integrated into a cell membrane or expressed endogenously within a cell are more likely to fold in the correct conformation than recombinantly produced free forms of the same protein.

In the context of a peptide or polypeptide, the term "fragment" as used herein refers to a peptide or polypeptide that comprises less than the full length amino acid sequence. Such a fragment may arise, for example, from a truncation at the amino terminus, a truncation at the carboxy terminus, and/or an internal deletion of a residue(s) from the amino acid sequence. Fragments may, for example, result from alternative RNA splicing or from in vivo protease activity. In certain embodiments, PD-L1 fragments include polypeptides comprising an amino acid sequence of at least 5 contiguous amino acid residues, at least 10 contiguous amino acid residues, at least 15 contiguous amino acid residues, at least 20 contiguous amino acid residues, at least 25 contiguous amino acid residues, at least 40 contiguous amino acid residues, at least 50 contiguous amino acid residues, at least 60 contiguous amino residues, at least 70 contiguous amino acid residues, at least 80 contiguous amino acid residues, at least 90 contiguous amino acid residues, at least contiguous 100 amino acid residues, at least 125 contiguous amino acid residues, at least 150 contiguous amino acid residues, at least 175 contiguous amino acid residues, at least 200 contiguous amino acid residues, or at least 250 contiguous amino acid residues of the amino acid sequence of a hPD-L1 polypeptide or an antibody that specifically binds to a hPD-L1 polypeptide. In a specific embodiment, a fragment of a hPD-L1 polypeptide or an antibody that specifically binds to a hPD-L1 antigen retains at least 1, at least 2, or at least 3 functions of the polypeptide or antibody.

The term "free" refers to a polypeptide, for example, PD-L1 or fragments and variants thereof, that is combined with a buffer, wherein the polypeptide is not associated with a cell surface or cell membrane. As such, the term "free" can refer to a polypeptide that is capable of surface expression (i.e. includes one or more transmembrane domains or membrane association domains), but that is not, in its present state, expressed on the surface of a cell or bound to a protein that is expressed on the surface of a cell. A free polypeptide can also refer to a free recombinant or native or unbound polypeptide. In the context of phage display, a free antigen can be selected in solution (referred to herein as a "soluble selection") or adsorbed to a surface, for example, adsorbed to the surface of a 96-well plate (referred to herein as "biopanning selection").

The term "fusion protein" as used herein refers to a polypeptide that comprises an amino acid sequence of an antibody and an amino acid sequence of a heterologous polypeptide or protein (i.e. a polypeptide or protein not normally a part of the antibody (e.g. a non-anti-hPD-L1 antigen antibody)). The term "fusion" when used in relation to hPD-L1 or to an anti-hPD-L1 antibody refers to the joining of a peptide or polypeptide, or fragment, variant and/or derivative thereof, with a heterologous peptide or polypeptide. Preferably, the fusion protein retains the biological activity of the hPD-L1 or anti-hPD-L1 antibody. In certain embodiments, the fusion protein comprises a hPD-L1 antibody VH domain, VL domain, VH CDR (one, two or three VH CDRs), and/or VL CDR (one, two or three VL CDRs), wherein the fusion protein specifically binds to a hPD-L1 epitope.

The term "heavy chain" when used with reference to an antibody refers to five distinct types, called alpha (α), delta (δ), epsilon (ε), gamma (γ) and mu (μ), based on the amino acid sequence of the heavy chain constant domain. These distinct types of heavy chains are well known and give rise to five classes of antibodies, IgA, IgD, IgE, IgG and IgM, respectively, including four subclasses of IgG, namely IgG1, IgG2, IgG3 and IgG4. Preferably the heavy chain is a human heavy chain. In the human population, multiple heavy chain constant region alleles, of each immunoglobulin or immunoglobulin subclass, exist. The nucleotide and amino acid sequences of these allelic variants are accessible on publicly available databases such as IMGT, ENSEMBL Swiss-Prot and Uniprot. Allelic variants may also be identified in various genome sequencing projects. In one embodiment, the antibodies and antibody fragments disclosed herein comprise a heavy chain encoded by a IgG1 constant region allele, which includes, but is not limited to, human IGHG1*01 (Seq ID Nos:340, 341 & 537), IGHG1*02 (Seq ID Nos:340, 341 &537), IGHG1*03 (Seq ID Nos:523 & 524), IGHG1*04 (Seq ID Nos:525 & 526) and IGHG1*05 (Seq ID Nos:340, 341 & 537). In one embodiment, the antibodies and antibody fragments disclosed herein comprise a protein encoded by a IgG2 constant region allele, which includes, but is not limited to, human IGHG2*01 (Seq ID Nos:527 & 528), IGHG2*02 (Seq ID Nos:529 & 530), IGHG2*03 (Seq ID Nos:527 & 528), IGHG2*04 (Seq ID Nos:531 & 532), IGHG2*05 (Seq ID Nos:527 & 528) and IGHG2*06 (Seq ID Nos:533 & 534). In one embodiment, the antibodies or antibody fragments disclosed herein comprise a protein encoded by a IgG3 constant region allele, which includes but is not limited to human IGHG3*01, IGHG3*02, IGHG3*03, IGHG3*04, IGHG3*05, IGHG3*06, IGHG3*07, IGHG3*08, IGHG3*09, IGHG3*10, IGHG3*11, IGHG3*12, IGHG3*13, IGHG3*14, IGHG3*15, IGHG3*16, IGHG3*17, IGHG3*18 and IGHG3*19. In one embodiment, the antibodies or antibody fragments disclosed herein comprise a protein encoded by a IgG4 constant region allele, which includes but is not limited to human IGHG4*01 (Seq ID Nos:192 & 193), IGHG4*02 (Seq ID Nos:194 & 195), IGHG4*03 (Seq ID Nos:196 & 197) and IGHG4*04 (Seq ID Nos:192 & 193). In another example, the heavy chain is a disabled IgG isotype, e.g. a disabled IgG4. In certain embodiments, the antibodies of the invention comprise a human gamma 4 constant region. In another embodiment, the heavy chain constant region does not bind Fc-γ receptors, and e.g. comprises a Leu235Glu mutation. In another embodiment, the heavy chain constant region comprises a Ser228Pro mutation to increase stability. In another embodiment, the heavy chain constant region is IgG4-PE (SEQ ID No:199. In another embodiment, the antibodies and antibody fragments disclosed herein comprise a heavy chain constant region encoded by a murine IgG1 constant region allele, which includes but is not limited to mouse IGHG1*01 or IGHG1*02. In one embodiment, the antibodies and antibody fragments disclosed herein comprise a heavy chain constant region encoded by a murine IgG2 constant region allele, which includes, but is not limited to, mouse IGHG2A*01, IGHG2A*02, IGHG2B*01, IGHG2B*02, IGHG2C*01, IGHG2C*02 or IGHG2C*03. In one embodiment, the antibodies or antibody fragments disclosed herein comprise a protein encoded by a murine IgG3 constant region allele, which includes but is not limited to mouse IGHG3*01.

The term "host" as used herein refers to an animal, preferably a mammal, and most preferably a human.

The term "host cell" as used herein refers to the particular subject cell transfected with a nucleic acid molecule and the progeny or potential progeny of such a cell. Progeny of such a cell may not be identical to the parent cell transfected with the nucleic acid molecule due to mutations or environmental influences that may occur in succeeding generations or integration of the nucleic acid molecule into the host cell genome.

The term "an IL-2 cytokine" as used herein refers to a cytokine-like molecule which has a similar activity to a wild-type IL-2. It may have activity at the high ($\alpha\beta\gamma$) affinity IL-2 receptor and/or the intermediate affinity ($\alpha\beta$) IL-2 receptor. The cytokine may be a variant IL-2 cytokine having one or more amino acid deletions, substitutions or additions. Variant cytokines are described in more detail hereinbelow.

The term "immunomodulatory agent" and variations thereof including, but not limited to, immunomodulatory agents, as used herein refer to an agent that modulates a host's immune system. In certain embodiments, an immunomodulatory agent is an immunosuppressant agent. In certain other embodiments, an immunomodulatory agent is an immunostimulatory agent. In accordance with the invention, an immunomodulatory agent used in the combination therapies of the invention does not include an anti-hPD-L1 antibody or antigen-binding fragment. Immunomodulatory agents include, but are not limited to, small molecules, peptides, polypeptides, proteins, fusion proteins, antibodies, inorganic molecules, mimetic agents, and organic molecules.

The term "in combination" in the context of the administration of other therapies refers to the use of more than one therapy. The use of the term "in combination" does not restrict the order in which therapies are administered to a subject with a disease. A first therapy can be administered before (e.g. 1 minute, 45 minutes, 30 minutes, 45 minutes, 1 hour, 2 hours, 4 hours, 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks), concurrently, or after (e.g. 1 minute, 45 minutes, 30 minutes, 45 minutes, 1 hour, 2 hours, 4 hours, 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks) the administration of a second therapy to a subject which had, has, or is susceptible to a hPD-L1-mediated disease. Any additional therapy can be administered in any order with the other additional therapies. In certain embodiments, the antibodies of the invention can be administered in combination with one or more therapies (e.g. therapies that are not the antibodies of the invention that are currently administered to prevent, treat, manage, and/or ameliorate a hPD-L1-mediated disease. Non-limiting examples of therapies that can be administered in combination with an antibody of the invention include analgesic agents, anaesthetic agents, antibiotics, or immunomodulatory agents or any other agent listed in the U.S. Pharmacopoeia and/or Physician's Desk Reference.

The term "immunocytokine", as used herein refers to an antibody format which is fused to a cytokine molecule. The antibody format may be any of those described herein, and the cytokine may be fused directly, or by means of a linker or chemical conjugation to either the N- or C-terminus of the heavy or the light chain of the antibody format.

As used herein, "injection device" refers to a device that is designed for carrying out injections, an injection including the steps of temporarily fluidically coupling the injection device to a person's tissue, typically the subcutaneous tissue. An injection further includes administering an amount of liquid drug into the tissue and decoupling or removing the injection device from the tissue. In some embodiments, an injection device can be an intravenous device or IV device, which is a type of injection device used when the target tissue is the blood within the circulatory system, e.g. the blood in a vein. A common, but non-limiting example of an injection device is a needle and syringe.

As used herein, "instructions" refers to a display of written, printed or graphic matter on the immediate container of an article, for example the written material displayed on a vial containing a pharmaceutically active agent, or details on the composition and use of a product of interest included in a kit containing a composition of interest. Instructions set forth the method of the treatment as contemplated to be administered or performed.

An "isolated" or "purified" antibody or protein is one that has been identified, separated and/or recovered from a component of its production environment (e.g. natural or recombinant). For example, the antibody or protein is substantially free of cellular material or other contaminating proteins from the cell or tissue source from which the antibody is derived, or substantially free of chemical precursors or other chemicals when chemically synthesized. The language "substantially free of cellular material" includes preparations of an antibody in which the antibody is separated from cellular components of the cells from which it is isolated or recombinantly produced. Thus, an antibody that is substantially free of cellular material includes preparations of antibody having less than about 30%, 20%, 10%, or 5% (by dry weight) of heterologous protein (also referred to herein as a "contaminating protein"). When the antibody is recombinantly produced, it is also preferably substantially free of culture medium, i.e. culture medium represents less than about 20%, 10%, or 5% of the volume of the protein preparation. When the antibody is produced by chemical synthesis, it is preferably substantially free of chemical precursors or other chemicals, i.e., it is separated from chemical precursors or other chemicals which are involved in the synthesis of the protein. Accordingly, such preparations of the antibody have less than about 30%, 20%, 10%, 5% (by dry weight) of chemical precursors or compounds other than the antibody of interest. In a preferred embodiment, antibodies of the invention are isolated or purified.

The terms "Kabat numbering," and like terms are recognized in the art and refer to a system of numbering amino acid residues which are more variable (i.e. hypervariable) than other amino acid residues in the heavy chain variable regions of an antibody, or an antigen binding portion thereof (Kabat et al., (1971) Ann. NY Acad. Sci., 190:382-391 and, Kabat et al. (1991) Sequences of Proteins of Immunological Interest, Fifth Edition, U.S. Department of Health and Human Services, NIH Publication No. 91-3242). For the heavy chain variable region, the hypervariable region typically ranges from amino acid positions 31 to 35 for CDR1, amino acid positions 50 to 65 for CDR2, and amino acid positions 95 to 102 for CDR3.

"Label" or "labelled" as used herein refers to the addition of a detectable moiety to a polypeptide, for example, a radiolabel, fluorescent label, enzymatic label, chemiluminescent label or a biotinyl group or gold. Radioisotopes or radionuclides may include $^{3}H$, $^{14}C$, $^{15}N$, $^{35}S$, $^{90}Y$, $^{99}Tc$, $^{115}In$, $^{125}I$, $^{131}I$, fluorescent labels may include rhodamine, lanthanide phosphors or FITC and enzymatic labels may include horseradish peroxidase, $\beta$-galactosidase, luciferase, alkaline phosphatase. Additional labels include, by way of illustration and not limitation: enzymes, such as glucose-6-phosphate dehydrogenase ("G6PDH"), alpha-D-galactosidase, glucose oxydase, glucose amylase, carbonic anhydrase, acetylcholinesterase, lysozyme, malate dehydrogenase and peroxidase; dyes (e.g. cyanine dyes, e.g. Cy5™, Cy5.5™. or Cy7™); additional fluorescent labels or fluorescers include, such as fluorescein and its derivatives, fluorochrome, GFP (GFP for "Green Fluorescent Protein"), other fluorescent proteins (e.g. mCherry, mTomato), dansyl, umbelliferone, phycoerythrin, phycocyanin, allophycocyanin, o-phthaldehyde, and fluorescamine; fluorophores such as lanthanide cryptates and chelates e.g. Europium etc (Perkin Elmer and Cisbio Assays); chemoluminescent labels or chemiluminescers, such as isoluminol, luminol and the dioxetanes; sensitisers; coenzymes; enzyme substrates; particles, such as latex or carbon particles; metal sol; crystallite; liposomes; cells, etc., which may be further labelled with a dye, catalyst or other detectable group; molecules such as biotin, digoxygenin or 5-bromodeoxyuridine; toxin moieties, such as for example a toxin moiety selected from a group of *Pseudomonas* exotoxin (PE or a cytotoxic fragment or mutant thereof), Diptheria toxin or a cytotoxic fragment or mutant thereof, a botulinum toxin A, B, C, D, E or F, ricin or a cytotoxic fragment thereof e.g. ricin A, abrin or a cytotoxic fragment thereof, saporin or a cytotoxic fragment thereof, pokeweed antiviral toxin or a cytotoxic fragment thereof and bryodin 1 or a cytotoxic fragment thereof.

The term "light chain" when used in reference to an antibody refers to the immunoglobulin light chains, of which there are two types in mammals, lambda (λ) and kappa (κ). Preferably, the light chain is a human light chain. Preferably the light chain constant region is a human constant region. In the human population, multiple light chain constant region alleles exist. The nucleotide and amino acid sequences of these allelic variants are accessible on publicly available databases such as IMGT, ENSEMBL, Swiss-Prot and Uniprot. In one embodiment, the antibodies or antibody fragments disclosed herein comprise a protein encoded by a human κ constant region allele, which includes, but is not limited to, IGKC*01 (Seq ID Nos:206 & 207), IGKC*02 (Seq ID Nos:208 & 209), IGKC*03 (Seq ID Nos:210 & 211), IGKC*04 (Seq ID Nos:212 & 213) and IGKC*05 (Seq ID Nos:214 & 215). In one embodiment, the antibodies or antibody fragments disclosed herein comprise a protein encoded by a human λ constant region allele, which includes but is not limited to IGLC1*01 (Seq ID Nos:216 & 217), IGLC1*02 (Seq ID Nos:218, 219 & 220), IGLC2*01 (Seq ID Nos:221, 222 & 538), IGLC2*02 (Seq ID Nos:224 & 225), IGLC2*03 (Seq ID Nos:224 & 225), IGLC3*01 (Seq ID Nos:226 & 227), IGLC3*02 (Seq ID Nos:228 & 229), IGLC3*03 (Seq ID Nos:230 & 231), IGLC3*04 (Seq ID Nos:232 & 233), IGLC6*01 (Seq ID Nos:234 & 235), IGLC7*01 (Seq ID Nos:236 & 237), IGLC7*02 (Seq ID Nos:236 & 237), IGLC7*03 (Seq ID Nos:535 & 536). In another embodiment, the antibodies and antibody fragments disclosed herein comprise a light chain constant region encoded by a mouse K constant region allele, which includes, but is not limited to, IGKC*01, IGKC*03 or IGKC*03. In another embodiment, the antibodies and antibody fragments disclosed herein comprise a light chain constant region encoded by a mouse A constant region allele, which includes, but is not limited to, IGLC1*01, IGLC2*01 or IGLC3*01.

"Percent (%) amino acid sequence identity" and "homology" with respect to a peptide, polypeptide or antibody sequence are defined as the percentage of amino acid residues in a candidate sequence that are identical with the amino acid residues in the specific peptide or polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or MEG ALIGN™ (DNASTAR) software. In one embodiment, the % homology is about 70%. In one embodiment, the % homology is about 75%. In one embodiment, the % homology is about 80%. In one embodiment, the % homology is about 85%. In one embodiment, the % homology is about 90%. In one embodiment, the % homology is about 92%. In one embodiment, the % homology is about 95%. In one embodiment, the % homology is about 97%. In one embodiment, the % homology is about 98%. In one embodiment, the % homology is about 99%. In one embodiment, the % homology is 100%.

The term "naturally occurring" or "native" when used in connection with biological materials such as nucleic acid molecules, polypeptides, host cells, and the like, refers to those which are found in nature and not manipulated by a human being.

As used herein, "packaging" refers to how the components are organized and/or restrained into a unit fit for distribution and/or use. Packaging can include, e.g. boxes, bags, syringes, ampoules, vials, tubes, clamshell packaging, barriers and/or containers to maintain sterility, labelling, etc.

The term "pharmaceutically acceptable" as used herein means being approved by a regulatory agency of the Federal or a state government, or listed in the U.S. Pharmacopeia, European Pharmacopeia or other generally recognized Pharmacopeia for use in animals, and more particularly in humans.

As used herein, the term "polynucleotide," "nucleotide," nucleic acid" "nucleic acid molecule" and other similar terms are used interchangeable and include DNA, RNA, mRNA and the like.

As used herein, the terms "prevent", "preventing", and "prevention" refer to the total or partial inhibition of the development, recurrence, onset or spread of a hPD-L1-mediated disease and/or symptom related thereto, resulting from the administration of a therapy or combination of therapies provided herein (e.g. a combination of prophylactic or therapeutic agents, such as an antibody of the invention).

The term "soluble" refers to a polypeptide, such as PD-L1 and variants or fragments thereof, that is lacking one or more transmembrane or cytoplasmic domains found in the native or membrane-associated form. In one embodiment, the "soluble" form of PD-L1 lacks both the transmembrane domain and the cytoplasmic domain.

The term "subject" or "patient" refers to any animal, including, but not limited to, mammals. As used herein, the term "mammal" refers to any vertebrate animal that suckle their young and either give birth to living young (eutharian or placental mammals) or are egg-laying (metatharian or nonplacental mammals). Examples of mammalian species include, but are not limited to, humans and other primates, including non-human primates such as chimpanzees and other apes and monkey species; farm animals such as cattle, sheep, pigs, goats and horses; domestic mammals such as dogs and cats; laboratory animals including rodents such as mice, rats (including cotton rats) and guinea pigs; birds, including domestic, wild and game birds such as chickens, turkeys and other gallinaceous birds, ducks, geese, and the like.

As used herein "substantially all" refers to refers to at least about 60%, at least about 70%, at least about 75%, at least about 80%, at least about 85%, at least about 90%, at least about 95%, at least about 98%, at least about 99%, or about 100%.

The term "substantially free of surfactant" as used herein refers to a formulation of an antibody that specifically binds to a hPD-L1 antigen, said formulation containing less than 0.0005%, less than 0.0003%, or less than 0.0001% of surfactants and/or less than 0.0005%, less than 0.0003%, or less than 0.0001% of surfactants.

The term "substantially free of salt" as used herein refers to a formulation of an antibody that specifically binds to a hPD-L1 antigen, said formulation containing less than 0.0005%, less than 0.0003%, or less than 0.0001% of inorganic salts.

The term "surfactant" as used herein refers to organic substances having amphipathic structures; namely, they are composed of groups of opposing solubility tendencies, typically an oil-soluble hydrocarbon chain and a water-soluble ionic group. Surfactants can be classified, depending on the charge of the surface-active moiety, into anionic, cationic, and non-ionic surfactants. Surfactants are often used as wetting, emulsifying, solubilizing, and dispersing agents for various pharmaceutical compositions and preparations of biological materials.

As used herein, the term "tag" refers to any type of moiety that is attached to, e.g. a polypeptide and/or a polynucleotide that encodes a hPD-L1 or hPD-L1 antibody or antigen binding fragment thereof. For example, a polynucleotide that encodes a hPD-L1, hPD-L1 antibody or antigen binding fragment thereof can contain one or more additional tag-encoding nucleotide sequences that encode e.g. a detectable moiety or a moiety that aids in affinity purification. When translated, the tag and the antibody can be in the form of a fusion protein. The term "detectable" or "detection" with reference to a tag refers to any tag that is capable of being visualized or wherein the presence of the tag is otherwise able to be determined and/or measured (e.g. by quantitation). A non-limiting example of a detectable tag is a fluorescent tag.

As used herein, the term "therapeutic agent" refers to any agent that can be used in the treatment, management or amelioration of a hPD-L1-mediated disease and/or a symptom related thereto. In certain embodiments, the term "therapeutic agent" refers to an antibody of the invention. In certain other embodiments, the term "therapeutic agent" refers to an agent other than an antibody of the invention. Preferably, a therapeutic agent is an agent which is known to be useful for, or has been or is currently being used for the treatment, management or amelioration of a hPD-L1-mediated disease or one or more symptoms related thereto. In specific embodiments, the therapeutic agent is a fully human anti-hPD-L1 antibody, such as a fully human anti-hPD-L1 monoclonal antibody.

As used herein, the term "therapy" refers to any protocol, method and/or agent that can be used in the prevention, management, treatment and/or amelioration of a hPD-L1-mediated disease (e.g. cancer). In certain embodiments, the terms "therapies" and "therapy" refer to a biological therapy, supportive therapy, and/or other therapies useful in the prevention, management, treatment and/or amelioration of a hPD-L1-mediated disease known to one of skill in the art such as medical personnel.

The terms "treat", "treatment" and "treating" refer to the reduction or amelioration of the progression, severity, and/or duration of a hPD-L1-mediated disease (e.g. cancer) resulting from the administration of one or more therapies (including, but not limited to, the administration of one or more prophylactic or therapeutic agents, such as an antibody of the invention). In specific embodiments, such terms refer to the reduction or inhibition of the binding of hPD-L1 to PD-1, the reduction or inhibition of the binding of hPD-L1 to CD80, and/or the inhibition or reduction of one or more symptoms associated with a hPD-L1-mediated disease, such as cancer. In specific embodiments, such terms refer to the reduction or inhibition of the binding of hPD-L1 to PD-1 and/or CD80, and/or the inhibition or reduction of one or more symptoms associated with a hPD-L1-mediated disease, such as cancer. In an example, the cell is a human cell. In specific embodiments, a prophylactic agent is a fully human anti-hPD-L1 antibody, such as a fully human anti-hPD-L1 monoclonal antibody.

The term "variable region" or "variable domain" refers to a portion of the light and heavy chains, typically about the amino-terminal 120 to 130 amino acids in the heavy chain and about 100 to 110 amino acids in the light chain, which differ extensively in sequence among antibodies and are used in the binding and specificity of each particular antibody for its particular antigen. The variability in sequence is concentrated in those regions called complimentarily determining regions (CDRs) while the more highly conserved regions in the variable domain are called framework regions (FR). The CDRs of the PD-L1 and heavy chains are primarily responsible for the interaction of the antibody with antigen. Numbering of amino acid positions used herein is according to the EU Index, as in Kabat et al (1991) Sequences of proteins of immunological interest. (U.S. Department of Health and Human Services, Washington, D.C.)$_5$,h ed. ("Kabat eta."). In preferred embodiments, the variable region is a human variable region.

Definitions of common terms in cell biology and molecular biology can be found in "The Merck Manual of Diagnosis and Therapy", $19^{th}$ Edition, published by Merck Research Laboratories, 2006 (ISBN 0-911910-19-0); Robert S. Porter eta. (eds.), The Encyclopedia of Molecular Biology, published by Blackwell Science Ltd., 1994 (ISBN 0-632-02182-9); Benjamin Lewin, Genes X, published by Jones & Bartlett Publishing, 2009 (ISBN-10: 0763766321); Kendrew et al. (Eds.), Molecular Biology and Biotechnology: a Comprehensive Desk Reference, published by VCH Publishers, Inc., 1995 (ISBN 1-56081-569-8) and Current Protocols in Protein Sciences 2009, Wiley Intersciences, Coligan et al., eds.

Unless otherwise stated, the present invention was performed using standard procedures, as described, for example in Sambrook et al., Molecular Cloning: A Laboratory Manual (4 ed.), Cold Spring Harbor Laboratory Press, Cold Spring Harbor, N.Y., USA (2012); Davis et al., Basic Methods in Molecular Biology, Elsevier Science Publishing, Inc., New York, USA (1995); or Methods in Enzymology: Guide to Molecular Cloning Techniques Vol. 152, S. L. Berger and A. R. Kimmel Eds., Academic Press Inc., San Diego, USA (1987); Current Protocols in Protein Science (CPPS) (John E. Coligan, et al., ed., John Wiley and Sons, Inc.), Current Protocols in Cell Biology (CPCB) (Juan S. Bonifacino et al. ed., John Wiley and Sons, Inc.), and Culture of Animal Cells: A Manual of Basic Technique by R. Ian Freshney, Publisher: Wiley-Liss; 5th edition (2005), Animal Cell Culture Methods (Methods in Cell Biology, Vol. 57, Jennie P. Mather and David Barnes editors, Academic Press, 1st edition, 1998) which are all incorporated by reference herein in their entireties.

Other terms are defined herein within the description of the various aspects of the invention.

2. PD-L1 Antibodies

Many tumour cells express surface molecules that are specific to cancer that can serve as diagnostic and/or therapeutic antibody targets. Examples of cell surface proteins expressed by tumour molecules that can be useful as biomarkers include, for example, members of the B7 family of proteins, major histocompatibility complex molecules (MHC), cytokine and growth factor receptors such as the receptor for eipdermal growth factor (EGFR). The B7 family is a group of proteins that are members of the immunoglobulin (Ig) superfamily of cell-surface proteins that bind to receptors on lymphocytes to regulate immune responses. The family includes transmembrane or glycosylphosphatidylinositol (GPI)-linked proteins characterized by extracellular Ig-like domains (IgV and IgC domains related to the variable and constant domains of immunoglobulins). All members have short cytoplasmic domains. There are seven known members of the B7 family: B7-1, B7-2, PD-L1 (B7-H1), PD-L2, B7-H2, B7-H3, and B7-H4.

The complete amino acid sequence for PD-L1 can be found in NCBI Reference Sequence: NP_054862.1 (SEQ ID No:1), which refers to many journal articles, including, for example, Dong, H., et al. (1999), "PD-L1, a third member of the B7 family, co-stimulates T-cell proliferation and interleukin-10 secretion," Nat. Med. 5 (12), 1365-1369, the disclosure of which is hereby incorporated by reference herein in its entirety. The amino acid sequence of PD-L1 includes a 30 amino acid long cytoplasmic domain that is unique to PD-L1, which shows little homology to other molecules, including other B7 family members.

In one embodiment, the antibody is a polyclonal antibody. Methods for generating polyclonal antibodies are known, and include, for example, inoculating a suitable mammal with an antigen to induce the immune system of the animal to produce immunoglobulins (IgGs) that specifically bind the injected antigen. Examples of suitable mammals include, for example, mouse, guinea pig, hamster, rat, rabbit sheep or goat. The polyclonal IgG is then typically purified from the mammal's serum. In one embodiment, the antibody is a polyclonal antibody that binds to a surface expressed protein. In another embodiment, the antibody is a polyclonal antibody that specifically binds to a member of the B7 family of proteins. In a more specific embodiment, the antibody is a polyclonal antibody that specifically binds PD-L1. In another embodiment, the antibody is a polyclonal antibody that specifically binds surface expressed PD-LI. In a more particular embodiment, the polyclonal antibody or antigen binding fragment thereof specifically binds human PD-L1. In another embodiment, the antibody is a polyclonal antibody that specifically binds soluble PD-L1. The term "soluble" also refers to a protein, such as PD-L1 that is lacking one or more transmembrane domain or cytoplasmic domains. In one embodiment, the "soluble" form of PD-L1 lacks both the transmembrane domain and the cytoplasmic domain. In one embodiment, the antibody is a polyclonal antibody that binds "free" PD-L1 (i.e. PD-L1 that is not associated with a cell membrane or surface, either directly or indirectly).

In another embodiment, the antibody can be a monoclonal antibody. Methods of making monoclonal antibodies are known and include, for example, fusing myeloma cells with the cells from an animal that was immunized with the desired antigen. In other embodiments, the monoclonal antibodies may be generated using recombinant DNA technology. In one embodiment, the antibody is a monoclonal antibody that specifically binds a surface expressed protein. In one embodiment, the antibody is a fully human monoclonal antibody. In another embodiment, the antibody is a monoclonal antibody that specifically binds to a member of the B7 family of proteins. In a more specific embodiment, the antibody is a monoclonal antibody that specifically binds PD-L1. In another embodiment, the antibody is a monoclonal antibody that specifically binds surface expressed PD-1. In a more particular embodiment, the monoclonal antibody or antigen binding fragment thereof specifically binds human PD-L1. In another embodiment, the antibody is a monoclonal antibody that specifically binds soluble PD-L1. In one embodiment, the antibody is a monoclonal antibody that specifically binds soluble PD-L1 that is lacking one or more transmembrane domain or cytoplasmic domains. In one embodiment, the antibody is a monoclonal antibody that specifically binds soluble PD-L1 that is lacking both the transmembrane domain and the cytoplasmic domain. In one embodiment, the antibody is a monoclonal antibody that binds "free" PD-L1 (i.e. PD-L1 that is not associated with a cell membrane or surface, either directly or indirectly).

In an example the binding site(s) of the antibody or fragment are selected from a plurality (e.g. library) of binding sites. For example, the plurality of binding sites comprises or consists of a plurality of 4-chain antibodies or fragments thereof, e.g. dAbs, Fabs or scFvs. Suitable methods for producing pluralities of binding sites for screening include phage display (producing a phage display library of antibody binding sites), ribosome display (producing a ribosome display library of antibody binding sites), yeast display (producing a yeast display library of antibody binding sites), or immunisation of a non-human vertebrate (e.g. a rodent, e.g. a mouse or rat, e.g. a Velocimouse™, Kymouse™, Xenomouse™, Aliva Mouse™, HuMab Mouse™, Omnimouse™, Omnirat™ or MeMo Mouse™) with hPD-L1 or a hPD-L1 epitope and isolation of a repertoire of antibody-producing cells (e.g. a B-cell, plasma cell or plasmablast repertoire) and/or a repertoire of isolated antibodies, fragments or binding sites.

PD-L1 binding ability, specificity and affinity (Kd, $K_{off}$ and/or $K_{on}$) can be determined by any routine method in the art, e.g. by surface plasmon resonance (SPR). The term "Kd" or "$K_D$", as used herein, is intended to refer to the equilibrium dissociation constant of a particular antibody-antigen interaction. Such binding measurements can be made using a variety of binding assays known in the art, e.g. using surface plasmon resonance (SPR), such as by Biacore™ or using the ProteOn XPR36™ (Bio-Rad®), using KinExA® (Sapidyne Instruments, Inc), or using ForteBio Octet (Pall ForteBio Corp.).

In one embodiment, the surface plasmon resonance (SPR) is carried out at 25° C. In another embodiment, the SPR is carried out at 37° C.

In one embodiment, the SPR is carried out at physiological pH, such as about pH7 or at pH7.6 (e.g. using Hepes buffered saline at pH 7.6 (also referred to as HBS-EP)).

In one embodiment, the SPR is carried out at a physiological salt level, e.g. 150 mM NaCl.

In one embodiment, the SPR is carried out at a detergent level of no greater than 0.05% by volume, e.g. in the presence of P20 (polysorbate 20; e.g. Tween 20™) at 0.05% and EDTA at 3 mM.

In one example, the SPR is carried out at 25° C. or 37° C. in a buffer at pH 7.6, 150 mM NaCl, 0.05% detergent (e.g. P20) and 3 mM EDTA. The buffer can contain 10 mM Hepes. In one example, the SPR is carried out at 25° C. or 37° C. in HBS-EP. HBS-EP is available from Teknova Inc. (California; catalogue number H8022).

In an example, the affinity of the antibody or fragment is determined using SPR by:
1. Coupling anti-mouse (or other relevant human, rat or non-human vertebrate antibody constant region species-matched) IgG (e.g. Biacore™ BR-1008-38) to a biosensor chip (e.g. GLM chip) such as by primary amine coupling;
2. Exposing the anti-mouse IgG (or other matched species antibody) to a test IgG antibody to capture test antibody on the chip;
3. Passing the test antigen over the chip's capture surface at 1024 nM, 256 nM, 64 nM, 16 nM, 4 nM with a 0 nM (i.e. buffer alone); and
4. And determining the affinity of binding of test antibody to test antigen using surface plasmon resonance, e.g. under an SPR condition discussed above (e.g. at 25° C. in physiological buffer). SPR can be carried out using any standard SPR apparatus, such as by Biacore™ or using the ProteOn XPR36™ (Bio-Rad®).

Regeneration of the capture surface can be carried out with 10 mM glycine at pH 1.7. This removes the captured antibody and allows the surface to be used for another interaction. The binding data can be fitted to 1:1 model inherent using standard techniques, e.g. using a model inherent to the ProteOn XPR36™ analysis software.

The present inventors have identified a number of antibodies having specificity for hPD-L1, which have a number of potential utilities and benefits over existing antibodies. For example, the antibodies described herein may have one or more of the following properties:
a. Specificity for blocking only one of the ligands of PD-L1 (e.g. blocks CD80/PD-L1 interaction, but not PD-1/PD-L1 interaction)
b. Immunogenicity/lack of side effects
c. Solubility
d. Stability
e. Ease of formulation
f. Frequency of dosing and/or route of administration, for example due to improved half-life over existing anti-PDL1 antibodies
g. Manufacturability (e.g. expression, ease of purification, isoforms)

1D05 has a heavy chain variable region ($V_H$) amino acid sequence of Seq ID No:33, comprising the CDRH1 amino acid sequence of Seq ID No:27 (IMGT) or Seq ID No:30 (Kabat), the CDRH2 amino acid sequence of Seq ID No:28 (IMGT) or Seq ID No:31 (Kabat), and the CDRH3 amino acid sequence of Seq ID No:29 (IMGT) or Seq ID No:32 (Kabat). The heavy chain nucleic acid sequence of the $V_H$ domain is Seq ID No:34. 1D05 has a light chain variable region ($V_L$) amino acid sequence of Seq ID No:43, comprising the CDRL1 amino acid sequence of Seq ID No:37 (IMGT) or Seq ID No:40 (Kabat), the CDRL2 amino acid sequence of Seq ID No:38 (IMGT) or Seq ID No:41 (Kabat), and the CDRL3 amino acid sequence of Seq ID No:39 (IMGT) or Seq ID No:42 (Kabat). The light chain nucleic acid sequence of the $V_L$ domain is Seq ID No:44. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:35 (heavy chain nucleic acid sequence Seq ID No:36). A full length light chain amino acid sequence is Seq ID No:45 (light chain nucleic acid sequence Seq ID No:46).

84G09 has a heavy chain variable ($V_H$) region amino acid sequence of Seq ID No:13, comprising the CDRH1 amino acid sequence of Seq ID No:7 (IMGT) or Seq ID No:10 (Kabat), the CDRH2 amino acid sequence of Seq ID No:8 (IMGT) or Seq ID No:11 (Kabat), and the CDRH3 amino acid sequence of Seq ID No:9 (IMGT) or Seq ID No:12 (Kabat). The heavy chain nucleic acid sequence of the $V_H$ domain is Seq ID No:14. 84G09 has a light chain variable region ($V_L$) amino acid sequence of Seq ID No:23, comprising the CDRL1 amino acid sequence of Seq ID No:17 (IMGT) or Seq ID No:20 (Kabat), the CDRL2 amino acid sequence of Seq ID No:18 (IMGT) or Seq ID No:21 (Kabat), and the CDRL3 amino acid sequence of Seq ID No:19 (IMGT) or Seq ID No:22 (Kabat). The light chain nucleic acid sequence of the $V_L$ domain is Seq ID No:24. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:15 (heavy chain nucleic acid sequence Seq ID No:16). A full length light chain amino acid sequence is Seq ID No:25 (light chain nucleic acid sequence Seq ID No:26).

1D05 HC mutant 1 has a heavy chain variable ($V_H$) region amino acid sequence of Seq ID No:47, comprising the CDRH1 amino acid sequence of Seq ID No:27 (IMGT) or Seq ID No:30 (Kabat), the CDRH2 amino acid sequence of Seq ID No:28 (IMGT) or Seq ID No:31 (Kabat), and the CDRH3 amino acid sequence of Seq ID No:29 (IMGT) or Seq ID No:32 (Kabat). 1D05 HC mutant 1 has a light chain variable region ($V_L$) amino acid sequence of Seq ID No:43, comprising the CDRL1 amino acid sequence of Seq ID No:37 (IMGT) or Seq ID No:40 (Kabat), the CDRL2 amino acid sequence of Seq ID No:38 (IMGT) or Seq ID No:41 (Kabat), and the CDRL3 amino acid sequence of Seq ID No:39 (IMGT) or Seq ID No:42 (Kabat). The light chain nucleic acid sequence of the $V_L$ domain is Seq ID No:44. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length light chain amino acid sequence is Seq ID No:45 (light chain nucleic acid sequence Seq ID No:46).

1D05 HC mutant 2 has a heavy chain variable ($V_H$) region amino acid sequence of Seq ID No:48, comprising the CDRH1 amino acid sequence of Seq ID No:27 (IMGT) or Seq ID No:30 (Kabat), the CDRH2 amino acid sequence of Seq ID No:28 (IMGT) or Seq ID No:31 (Kabat), and the CDRH3 amino acid sequence of Seq ID No:29 (IMGT) or Seq ID No:32 (Kabat). 1D05 HC mutant 2 has a light chain variable region ($V_L$) amino acid sequence of Seq ID No:43, comprising the CDRL1 amino acid sequence of Seq ID No:37 (IMGT) or Seq ID No:40 (Kabat), the CDRL2 amino acid sequence of Seq ID No:38 (IMGT) or Seq ID No:41 (Kabat), and the CDRL3 amino acid sequence of Seq ID No:39 (IMGT) or Seq ID No:42 (Kabat). The light chain nucleic acid sequence of the $V_L$ domain is Seq ID No:44. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length light chain amino acid sequence is Seq ID No:45 (light chain nucleic acid sequence Seq ID No:46).

1D05 HC mutant 3 has a heavy chain variable ($V_H$) region amino acid sequence of Seq ID No:49, comprising the CDRH1 amino acid sequence of Seq ID No:27 (IMGT) or Seq ID No:30 (Kabat), the CDRH2 amino acid sequence of Seq ID No:28 (IMGT) or Seq ID No:31 (Kabat), and the CDRH3 amino acid sequence of Seq ID No:29 (IMGT) or Seq ID No:32 (Kabat). 1D05 HC mutant 3 has a light chain variable region ($V_L$) amino acid sequence of Seq ID No:43, comprising the CDRL1 amino acid sequence of Seq ID No:37 (IMGT) or Seq ID No:40 (Kabat), the CDRL2 amino acid sequence of Seq ID No:38 (IMGT) or Seq ID No:41 (Kabat), and the CDRL3 amino acid sequence of Seq ID No:39 (IMGT) or Seq ID No:42 (Kabat). The light chain nucleic acid sequence of the $V_L$ domain is Seq ID No:44. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length light chain amino acid sequence is Seq ID No:45 (light chain nucleic acid sequence Seq ID No:46).

1D05 HC mutant 4 has a heavy chain variable ($V_H$) region amino acid sequence of Seq ID No:342, comprising the CDRH1 amino acid sequence of Seq ID No:27 (IMGT) or Seq ID No:30 (Kabat), the CDRH2 amino acid sequence of Seq ID No:28 (IMGT) or Seq ID No:31 (Kabat), and the CDRH3 amino acid sequence of Seq ID No:29 (IMGT) or Seq ID No:32 (Kabat). 1D05 HC mutant 4 has a light chain variable region ($V_L$) amino acid sequence of Seq ID No:43, comprising the CDRL1 amino acid sequence of Seq ID No:37 (IMGT) or Seq ID No:40 (Kabat), the CDRL2 amino acid sequence of Seq ID No:38 (IMGT) or Seq ID No:41 (Kabat), and the CDRL3 amino acid sequence of Seq ID No:39 (IMGT) or Seq ID No:42 (Kabat). The light chain nucleic acid sequence of the $V_L$ domain is Seq ID No:44. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length light chain amino acid sequence is Seq ID No:45 (light chain nucleic acid sequence Seq ID No:46).

1D05 LC mutant 1 has a heavy chain variable ($V_H$) region amino acid sequence of Seq ID No:33, comprising the CDRH1 amino acid sequence of Seq ID No:27 (IMGT) or Seq ID No:30 (Kabat), the CDRH2 amino acid sequence of Seq ID No:28 (IMGT) or Seq ID No:31 (Kabat), and the CDRH3 amino acid sequence of Seq ID No:29 (IMGT) or Seq ID No:32 (Kabat). The heavy chain nucleic acid sequence of the $V_H$ domain is Seq ID No:34. 1D05 LC mutant 1 has a light chain variable region ($V_L$) amino acid sequence of Seq ID No:50, comprising the CDRL1 amino acid sequence of Seq ID No:37 (IMGT) or Seq ID No:40 (Kabat), and the CDRL3 amino acid sequence of Seq ID No:39 (IMGT) or Seq ID No:42 (Kabat). The CDRL2 sequence of 1D05 LC Mutant 1 is as defined by the Kabat or IMGT systems from the $V_L$ sequence of Seq ID No:50. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:35 (heavy chain nucleic acid sequence Seq ID No:36).

1D05 LC mutant 2 has a heavy chain variable ($V_H$) region amino acid sequence of Seq ID No:33, comprising the CDRH1 amino acid sequence of Seq ID No:27 (IMGT) or Seq ID No:30 (Kabat), the CDRH2 amino acid sequence of Seq ID No:28 (IMGT) or Seq ID No:31 (Kabat), and the CDRH3 amino acid sequence of Seq ID No:29 (IMGT) or Seq ID No:32 (Kabat). The heavy chain nucleic acid sequence of the $V_H$ domain is Seq ID No:34. 1D05 LC mutant 2 has a light chain variable region ($V_L$) amino acid sequence of Seq ID No:51, comprising the CDRL1 amino acid sequence of Seq ID No:37 (IMGT) or Seq ID No:40 (Kabat), the CDRL2 amino acid sequence of Seq ID No:38 (IMGT) or Seq ID No:41 (Kabat), and the CDRL3 amino acid sequence of Seq ID No:39 (IMGT) or Seq ID No:42 (Kabat). The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:35 (heavy chain nucleic acid sequence Seq ID No:36).

1D05 LC mutant 3 has a heavy chain variable ($V_H$) region amino acid sequence of Seq ID No:33, comprising the CDRH1 amino acid sequence of Seq ID No:27 (IMGT) or Seq ID No:30 (Kabat), the CDRH2 amino acid sequence of Seq ID No:28 (IMGT) or Seq ID No:31 (Kabat), and the CDRH3 amino acid sequence of Seq ID No:29 (IMGT) or Seq ID No:32 (Kabat). The heavy chain nucleic acid sequence of the $V_H$ domain is Seq ID No:34. 1D05 LC mutant 3 has a light chain variable region (V$_L$) amino acid sequence of Seq ID No:298, comprising the CDRL1 amino acid sequence of Seq ID No:37 (IMGT) or Seq ID No:40 (Kabat), and the CDRL3 amino acid sequence of Seq ID No:39 (IMGT) or Seq ID No:42 (Kabat). The CDRL2 sequence of 1D05 LC Mutant 3 is as defined by the Kabat or IMGT systems from the V$_L$ sequence of Seq ID No:298. The light chain nucleic acid sequence of the V$_L$ domain is Seq ID No:44. The V$_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The V$_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:35 (heavy chain nucleic acid sequence Seq ID No:36). A full length light chain amino acid sequence is Seq ID No:45 (light chain nucleic acid sequence Seq ID No:46).

411B08 has a heavy chain variable (V$_H$) region amino acid sequence of Seq ID No:58, comprising the CDRH1 amino acid sequence of Seq ID No:52 (IMGT) or Seq ID No:55 (Kabat), the CDRH2 amino acid sequence of Seq ID No:53 (IMGT) or Seq ID No:56 (Kabat), and the CDRH3 amino acid sequence of Seq ID No:54 (IMGT) or Seq ID No:57 (Kabat). The heavy chain nucleic acid sequence of the V$_H$ domain is Seq ID No:59. 411B08 has a light chain variable region (V$_L$) amino acid sequence of Seq ID No:68, comprising the CDRL1 amino acid sequence of Seq ID No:62 (IMGT) or Seq ID No:65 (Kabat), the CDRL2 amino acid sequence of Seq ID No:63 (IMGT) or Seq ID No:66 (Kabat), and the CDRL3 amino acid sequence of Seq ID No:64 (IMGT) or Seq ID No:67 (Kabat). The light chain nucleic acid sequence of the V$_L$ domain is Seq ID No:69. The V$_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The V$_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:60 (heavy chain nucleic acid sequence Seq ID No:61). A full length light chain amino acid sequence is Seq ID No:70 (light chain nucleic acid sequence Seq ID No:71).

411C04 has a heavy chain variable (V$_H$) region amino acid sequence of Seq ID No:78, comprising the CDRH1 amino acid sequence of Seq ID No:72 (IMGT) or Seq ID No:75 (Kabat), the CDRH2 amino acid sequence of Seq ID No:73 (IMGT) or Seq ID No:76 (Kabat), and the CDRH3 amino acid sequence of Seq ID No:74 (IMGT) or Seq ID No:77 (Kabat). The heavy chain nucleic acid sequence of the V$_H$ domain is Seq ID No:79. 411C04 has a light chain variable region (V$_L$) amino acid sequence of Seq ID No:88, comprising the CDRL1 amino acid sequence of Seq ID No:82 (IMGT) or Seq ID No:85 (Kabat), the CDRL2 amino acid sequence of Seq ID No:83 (IMGT) or Seq ID No:86 (Kabat), and the CDRL3 amino acid sequence of Seq ID No:84 (IMGT) or Seq ID No:87 (Kabat). The light chain nucleic acid sequence of the V$_L$ domain is Seq ID No:89. The V$_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The V$_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:80 (heavy chain nucleic acid sequence Seq ID No:81). A full length light chain amino acid sequence is Seq ID No:90 (light chain nucleic acid sequence Seq ID No:91).

411D07 has a heavy chain variable (V$_H$) region amino acid sequence of Seq ID No:98, comprising the CDRH1 amino acid sequence of Seq ID No:92 (IMGT) or Seq ID No:95 (Kabat), the CDRH2 amino acid sequence of Seq ID No:93 (IMGT) or Seq ID No:96 (Kabat), and the CDRH3 amino acid sequence of Seq ID No:94 (IMGT) or Seq ID No:97 (Kabat). The heavy chain nucleic acid sequence of the V$_H$ domain is Seq ID No:99. 411D07 has a light chain variable region (V$_L$) amino acid sequence of Seq ID No:108, comprising the CDRL1 amino acid sequence of Seq ID No:102 (IMGT) or Seq ID No:105 (Kabat), the CDRL2 amino acid sequence of Seq ID No:103 (IMGT) or Seq ID No:106 (Kabat), and the CDRL3 amino acid sequence of Seq ID No:104 (IMGT) or Seq ID No:107 (Kabat). The light chain nucleic acid sequence of the V$_L$ domain is Seq ID No:109. The V$_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The V$_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:100 (heavy chain nucleic acid sequence Seq ID No:101). A full length light chain amino acid sequence is Seq ID No:110 (light chain nucleic acid sequence Seq ID No:111).

385F01 has a heavy chain variable (V$_H$) region amino acid sequence of Seq ID No:118, comprising the CDRH1 amino acid sequence of Seq ID No:112 (IMGT) or Seq ID No:115 (Kabat), the CDRH2 amino acid sequence of Seq ID No:113 (IMGT) or Seq ID No:116 (Kabat), and the CDRH3 amino acid sequence of Seq ID No:114 (IMGT) or Seq ID No:117 (Kabat). The heavy chain nucleic acid sequence of the V$_H$ domain is Seq ID No:119. 385F01 has a light chain variable region (V$_L$) amino acid sequence of Seq ID No:128, comprising the CDRL1 amino acid sequence of Seq ID No:122 (IMGT) or Seq ID No:125 (Kabat), the CDRL2 amino acid sequence of Seq ID No:123 (IMGT) or Seq ID No:126 (Kabat), and the CDRL3 amino acid sequence of Seq ID No:124 (IMGT) or Seq ID No:127 (Kabat). The light chain nucleic acid sequence of the V$_L$ domain is Seq ID No:129. The V$_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The V$_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:120 (heavy chain nucleic acid sequence Seq ID No:121). A full length light chain amino acid sequence is Seq ID No:130 (light chain nucleic acid sequence Seq ID No:131).

386H03 has a heavy chain variable ($V_H$) region amino acid sequence of Seq ID No:158, comprising the CDRH1 amino acid sequence of Seq ID No:152 (IMGT) or Seq ID No:155 (Kabat), the CDRH2 amino acid sequence of Seq ID No:153 (IMGT) or Seq ID No:156 (Kabat), and the CDRH3 amino acid sequence of Seq ID No:154 (IMGT) or Seq ID No:157 (Kabat). The heavy chain nucleic acid sequence of the $V_H$ domain is Seq ID No:159. 386H03 has a light chain variable region ($V_L$) amino acid sequence of Seq ID No:168, comprising the CDRL1 amino acid sequence of Seq ID No:162 (IMGT) or Seq ID No:165 (Kabat), the CDRL2 amino acid sequence of Seq ID No:163 (IMGT) or Seq ID No:166 (Kabat), and the CDRL3 amino acid sequence of Seq ID No:164 (IMGT) or Seq ID No:167 (Kabat). The light chain nucleic acid sequence of the $V_L$ domain is Seq ID No:169. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:160 (heavy chain nucleic acid sequence Seq ID No:161). A full length light chain amino acid sequence is Seq ID No:170 (light chain nucleic acid sequence Seq ID No:171).

389A03 has a heavy chain variable ($V_H$) region amino acid sequence of Seq ID No:178, comprising the CDRH1 amino acid sequence of Seq ID No:172 (IMGT) or Seq ID No:175 (Kabat), the CDRH2 amino acid sequence of Seq ID No:173 (IMGT) or Seq ID No:176 (Kabat), and the CDRH3 amino acid sequence of Seq ID No:174 (IMGT) or Seq ID No:177 (Kabat). The heavy chain nucleic acid sequence of the $V_H$ domain is Seq ID No:179. 389A03 has a light chain variable region ($V_L$) amino acid sequence of Seq ID No:188, comprising the CDRL1 amino acid sequence of Seq ID No:182 (IMGT) or Seq ID No:185 (Kabat), the CDRL2 amino acid sequence of Seq ID No:183 (IMGT) or Seq ID No:186 (Kabat), and the CDRL3 amino acid sequence of Seq ID No:184 (IMGT) or Seq ID No:187 (Kabat). The light chain nucleic acid sequence of the $V_L$ domain is Seq ID No:189. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:180 (heavy chain nucleic acid sequence Seq ID No:181). A full length light chain amino acid sequence is Seq ID No:190 (light chain nucleic acid sequence Seq ID No:191).

413D08 has a heavy chain variable ($V_H$) region amino acid sequence of Seq ID No:138, comprising the CDRH1 amino acid sequence of Seq ID No:132 (IMGT) or Seq ID No:135 (Kabat), the CDRH2 amino acid sequence of Seq ID No:133 (IMGT) or Seq ID No:136 (Kabat), and the CDRH3 amino acid sequence of Seq ID No:134 (IMGT) or Seq ID No:137 (Kabat). The heavy chain nucleic acid sequence of the $V_H$ domain is Seq ID No:139. 413D08 has a light chain variable region ($V_L$) amino acid sequence of Seq ID No:148, comprising the CDRL1 amino acid sequence of Seq ID No:142 (IMGT) or Seq ID No:145 (Kabat), the CDRL2 amino acid sequence of Seq ID No:143 (IMGT) or Seq ID No:146 (Kabat), and the CDRL3 amino acid sequence of Seq ID No:144 (IMGT) or Seq ID No:147 (Kabat). The light chain nucleic acid sequence of the $V_L$ domain is Seq ID No:149. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No: 140 (heavy chain nucleic acid sequence Seq ID No:141). A full length light chain amino acid sequence is Seq ID No:150 (light chain nucleic acid sequence Seq ID No:151).

413G05 has a heavy chain variable ($V_H$) region amino acid sequence of Seq ID No:244, comprising the CDRH1 amino acid sequence of Seq ID No:238 (IMGT) or Seq ID No:241 (Kabat), the CDRH2 amino acid sequence of Seq ID No:239 (IMGT) or Seq ID No:242 (Kabat), and the CDRH3 amino acid sequence of Seq ID No:240 (IMGT) or Seq ID No:243 (Kabat). The heavy chain nucleic acid sequence of the $V_H$ domain is Seq ID No:245. 413G05 has a light chain variable region ($V_L$) amino acid sequence of Seq ID No:254, comprising the CDRL1 amino acid sequence of Seq ID No:248 (IMGT) or Seq ID No:251 (Kabat), the CDRL2 amino acid sequence of Seq ID No:249 (IMGT) or Seq ID No:252 (Kabat), and the CDRL3 amino acid sequence of Seq ID No:250 (IMGT) or Seq ID No:253 (Kabat). The light chain nucleic acid sequence of the $V_L$ domain is Seq ID No:255. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:246 (heavy chain nucleic acid sequence Seq ID No:247). A full length light chain amino acid sequence is Seq ID No:256 (light chain nucleic acid sequence Seq ID No:257).

413F09 has a heavy chain variable ($V_H$) region amino acid sequence of Seq ID No:264, comprising the CDRH1 amino acid sequence of Seq ID No:258 (IMGT) or Seq ID No:261 (Kabat), the CDRH2 amino acid sequence of Seq ID No:259 (IMGT) or Seq ID No:262 (Kabat), and the CDRH3 amino acid sequence of Seq ID No:260 (IMGT) or Seq ID No:263 (Kabat). The heavy chain nucleic acid sequence of the $V_H$ domain is Seq ID No:265. 413F09 has a light chain variable region ($V_L$) amino acid sequence of Seq ID No:274, comprising the CDRL1 amino acid sequence of Seq ID No:268 (IMGT) or Seq ID No:271 (Kabat), the CDRL2 amino acid sequence of Seq ID No:269 (IMGT) or Seq ID No:272 (Kabat), and the CDRL3 amino acid sequence of Seq ID No:270 (IMGT) or Seq ID No:273 (Kabat). The light chain nucleic acid sequence of the $V_L$ domain is Seq ID No:275. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:266 (heavy chain nucleic acid sequence Seq ID No:267). A full length light chain amino acid sequence is Seq ID No:276 (light chain nucleic acid sequence Seq ID No:277).

414B06 has a heavy chain variable ($V_H$) region amino acid sequence of Seq ID No:284, comprising the CDRH1 amino acid sequence of Seq ID No:278 (IMGT) or Seq ID No:281 (Kabat), the CDRH2 amino acid sequence of Seq ID No:279 (IMGT) or Seq ID No:282 (Kabat), and the CDRH3 amino acid sequence of Seq ID No:280 (IMGT) or Seq ID No:283 (Kabat). The heavy chain nucleic acid sequence of the $V_H$ domain is Seq ID No:285. 414B06 has a light chain variable region ($V_L$) amino acid sequence of Seq ID No:294, comprising the CDRL1 amino acid sequence of Seq ID No:288 (IMGT) or Seq ID No:291(Kabat), the CDRL2 amino acid sequence of Seq ID No:289 (IMGT) or Seq ID No:292 (Kabat), and the CDRL3 amino acid sequence of Seq ID No:290 (IMGT) or Seq ID No:293 (Kabat). The light chain nucleic acid sequence of the $V_L$ domain is Seq ID No:295. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:286 (heavy chain nucleic acid sequence Seq ID No:287). A full length light chain amino acid sequence is Seq ID No:296 (light chain nucleic acid sequence Seq ID No:297).

416E01 has a heavy chain variable region ($V_H$) amino acid sequence of Seq ID No:349, comprising the CDRH1 amino acid sequence of Seq ID No:343 (IMGT) or Seq ID No:346 (Kabat), the CDRH2 amino acid sequence of Seq ID No:344 (IMGT) or Seq ID No:347 (Kabat), and the CDRH3 amino acid sequence of Seq ID No:345 (IMGT) or Seq ID No:348 (Kabat). The heavy chain nucleic acid sequence of the $V_H$ domain is Seq ID No:350. 416E01 has a light chain variable region ($V_L$) amino acid sequence of Seq ID No:359, comprising the CDRL1 amino acid sequence of Seq ID No:353 (IMGT) or Seq ID No:356 (Kabat), the CDRL2 amino acid sequence of Seq ID No:354 (IMGT) or Seq ID No:357 (Kabat), and the CDRL3 amino acid sequence of Seq ID No:355 (IMGT) or Seq ID No:358 (Kabat). The light chain nucleic acid sequence of the $V_L$ domain is Seq ID No:360. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:351 (heavy chain nucleic acid sequence Seq ID No:352). A full length light chain amino acid sequence is Seq ID No:361 (light chain nucleic acid sequence Seq ID No:362).

The antibodies of the invention are described with respect to the following concepts, aspects, sentences, arrangements and embodiments. Unless otherwise stated, all concepts, embodiments, sentences, arrangements and aspects are to be read as being able to be combined with any other concept, aspect, sentence, arrangement or embodiment, unless such combination would not make technical sense or is explicitly stated otherwise.

Concept 1. An antibody or a fragment thereof, which specifically binds to hPD-L1 as defined by Seq ID No:1, and competes for binding to said hPD-L1 with the antibody 1D05, wherein the antibody or fragment comprises a $V_H$ domain which comprises a CDRH3 comprising the motif $X_1GSGX_2YGX_3X_4FD$ (SEQ ID NO: 753), wherein $X_1$, $X_2$ and $X_3$ are independently any amino acid, and $X_4$ is either present or absent, and if present, may be any amino acid.

In these concepts, antibodies or fragments may include or may not include bispecific antibodies. In one embodiment, in these concepts, antibodies or fragments includes bispecific antibodies. In one embodiment, a bispecific antibody does not include a FIT-Ig format. In one embodiment, a bispecific antibody does not include a mAb² format. In one embodiment, a bispecific antibody does not include either a FIT-Ig format or a mAb² format. In one embodiment, the antibody or fragment in these concepts includes a bispecific antibody, but does not include a bispecific antibody having a FIT-Ig format. In one embodiment, the antibody or fragment in these concepts includes a bispecific antibody, but does not include a bispecific antibody having a mAb² format. In one embodiment, the antibody or fragment in these concepts includes a bispecific antibody, but does not include a bispecific antibody having a FIT-Ig format or a mAb² format. In another embodiment, in these concepts, antibodies or fragments include dual binding antibodies.

Preferably, an antibody or a fragment thereof that specifically binds to a hPD-L1 antigen does not cross-react with other antigens (but may optionally cross-react with PD-L1 of a different species, e.g., rhesus, cynomolgus, or murine). An antibody or a fragment thereof that specifically binds to a hPD-L1 antigen can be identified, for example, by immunoassays, BIAcore™, or other techniques known to those of skill in the art. An antibody or a fragment thereof binds specifically to a hPD-L1 antigen when it binds to a hPD-L1 antigen with higher affinity than to any cross-reactive antigen as determined using experimental techniques, such as radioimmunoassays (RIA) and enzyme-linked immunosorbent assays (ELISAs). Typically, a specific or selective reaction will be at least twice background signal or noise and more typically more than 10 times background. See, e.g. Paul, ed., 1989, Fundamental Immunology Second Edition, Raven Press, New York at pages 332-336 for a discussion regarding antibody specificity.

In one embodiment, the antibody or fragment is a human antibody. In one embodiment, the antibody or fragment is a human antibody or fragment. In one embodiment, the antibody or fragment is a fully human antibody or fragment. In one embodiment, the antibody or fragment is a fully human monoclonal antibody or fragment.

There is also provided concept 1a: An antibody or a fragment thereof, that specifically binds to hPD-L1 as defined by Seq ID No:1, and competes for binding to said hPD-L1 with the antibody 411B08, wherein the antibody or fragment comprises a $V_H$ domain which comprises a CDRH3 comprising the motif $ARX_1RX_2X_3SDX_4X_5D$, wherein $X_1$, $X_2$, $X_3$, $X_4$ and $X_5$ are independently any amino acid.

There is also provided concept 1b: An antibody or a fragment thereof, that specifically binds to hPD-L1 as defined by Seq ID No:1, and competes for binding to said hPD-L1 with the antibody 411B08, wherein the antibody or fragment comprises a $V_H$ domain which comprises a CDRH3 comprising the motif $X_1RDGSGSY$, wherein $X_1$ is any amino acid.

As provided in the concepts or aspects herein, an anti-PD-L1 antibody or immunocytokine may bind to PD-L1, e.g. human PD-L1 with a $K_D$ of less than 50 nM, less than 40 nM, less than 30 nM as determined by surface plasmon resonance. Another embodiment, anti-PD-L1 antibody or immunocytokine may bind to PD-L1, e.g. human PD-L1 with a $K_D$ of less than 20 nM, less than 15 nM, less than 10 nM as determined by surface plasmon resonance. anti-PD-L1 antibody or immunocytokine may bind to PD-L1, e.g. human PD-L1 with a $K_D$ of less than 8 nM, less than 5 nM, less than 4 nM, less than 3 nM, less than 2 nM or less than 1 nM as determined by surface plasmon resonance. The $K_D$ may be 0.9 nM or less, 0.8 nM or less, 0.7 nM or less, 0.6 nM or less, 0.5 nM or less, 0.4 nM or less, 0.3 nM or less, 0.2 nM or less, or 0.1 nM or less.

In another embodiment, the $K_D$ is within a range of 0.01 to 1 nM, or a range of 0.05 to 2 nM, or a range of 0.05 to 1 nM. The $K_D$ may be with regard to hPD-L1, cynoPD-L1 and/or mouse PD-1.

In another embodiment, the anti-PD-L1 antibodies described herein have a $K_{ON}$ rate (e.g. as measured by SPR, e.g. at 25° C. or at 37° C.) of approximately 0.5 to 10 μM, for example approximately 1 to 8 μM or approximately 1 to 7 μM. In another embodiment, the $K_{ON}$ rate is approximately 1 to 5 μM, e.g. approximately 1 μM, approximately 1.5 μM, approximately 2 μM, approximately 2.5 μM or approximately 3 μM. In another embodiment, the $K_{ON}$ rate is approximately 3.5 μM, approximately 4 μM, approximately 4.5 μM, approximately 5 μM or approximately 5.5 μM.

In another embodiment, the anti-PD-L1 antibodies described herein have a $K_{OFF}$ rate (e.g. as measured by SPR, e.g. at 25° C. or at 37° C.) of approximately 0.01 to 100 mM, for example approximately 0.1 to 50 mM or approximately 0.5 to 50 mM. In another embodiment, the $K_{OFF}$ rate is approximately 0.5 to 10 mM, or approximately 0.5 to 10 mM, e.g. approximately 1 mM, approximately 2 mM, approximately 3 mM, approximately 4 mM or approximately 5 mM. In another embodiment, the $K_{OFF}$ rate is approximately 0.6 mM, approximately 0.7 mM, approximately 0.8 mM or approximately 0.9 mM.

In another embodiment, the anti-PD-L1 antibodies (and immunocytokines) described in the concepts and aspects herein provide improved transient expression levels over other anti-PD-L1 antibodies and immunocytokines. Thus, in one embodiment, the anti-PD-L1 antibody (or immunocytokine) is expressed in a HEK293 cell, e.g. a HEK293T cell, at an expression level of approximately 100 μg/mL, or in a range of approximately 100 to 350 μg/mL. In another embodiment, the expression level is above approximately 350 μg/mL.

In another embodiment, the anti-PD-L1 antibody (or immunocytokine) is expressed in a CHO cell, e.g. an Expi-CHO cell, at an expression level of approximately 100 μg/mL, or in a range of approximately 100 to 350 μg/mL. In another embodiment, the expression level is above approximately 350 μg/mL.

In another embodiment, the anti-PD-L1 antibody (or immunocytokine) is expressed in a CHO cell, e.g. an Expi-CHO cell or a CHO-E7 EBNA cell, at an expression level of approximately 100 μg/mL, or in a range of approximately 100 to 350 μg/mL. In another embodiment, the expression level is above approximately 350 μg/mL. The antibody described herein as 1D05, formatted as a human IgG1 (Seq ID No:340), at 2 L volume in CHO-E7 EBNA cells has an expression level of approximately 115 μg/mL. The antibody described herein as 416E01, formatted as a human IgG1 (Seq ID No:340), at 2 L volume in CHO-E7 EBNA cells has an expression level of approximately 160 μg/mL. The antibody described herein as 1414B06, formatted as a human IgG1 (Seq ID No:340), at 2 L volume in CHO-E7 EBNA cells has an expression level of approximately 783 μg/mL. The antibody described herein as 413G05, formatted as a human IgG1 (Seq ID No:340), at 2 L volume in CHO-E7 EBNA cells has an expression level of approximately 383 μg/mL.

In any of these expression systems, the expression is carried out of a scale of between approximately 0.5 mL and 3 mL, for example between approximately 0.5 mL and 2 mL. In any of these expression systems, the anti-PD-L1 antibody (or immunocytokine) may be expressed from a pTT5 vector. In any of these expression systems, the anti-PD-L1 antibody (or immunocytokine) may be expressed in conjunction with a lipid transfection reagent, and may optionally be expressed in a CHO cell, e.g. an Expi-CHO cell. In any of these expression systems, the anti-PD-L1 antibody (or immunocytokine) may be expressed in conjunction with a PEI transfection reagent, and may optionally be expressed in a CHO cell, e.g. an CHO-E7 EBNA cell. In any of these expression systems, the anti-PD-L1 antibody (or immunocytokine) may be expressed in conjunction with a helper plasmid (e.g. an AKT helper plasmid), and may optionally be expressed in a CHO cell, e.g. an CHO-E7 EBNA cell.

In any of these expression systems, the expression level is between approximately 100 μg/mL and approximately 1500 μg/mL, for example between approximately 100 μg/mL and approximately 1000 μg/mL, or between approximately 200 μg/mL and approximately 1000 μg/mL, or between approximately 350 μg/mL and approximately 1000 μg/mL. In any of these expression systems, the lower limit of expression may be approximately 100 μg/mL, approximately 200 μg/mL, approximately 300 μg/mL, or approximately 400 μg/mL. In another embodiment, the lower limit of expression may be approximately 500 μg/mL, approximately 600 μg/mL, approximately 700 μg/mL, or approximately 800 μg/mL. In any of these expression systems, the upper limit of expression may be approximately 2000 μg/mL, approximately 1800 μg/mL, approximately 1600 μg/mL, or approximately 1500 μg/mL. In another embodiment, the upper limit of expression may be approximately 1250 μg/mL, approximately 1000 μg/mL, approximately 900 μg/mL, or approximately 800 μg/mL.

In another embodiment, the expression system is a Lonza expression system, e.g. Lonza X-Ceed® system. In the Lonza expression system, the expression may be carried out at a scale of approximately 30 mL to 2 L, for example 50 mL to 1 L, or 1 L tp 2 L. In the Lonza expression system, the anti-PD-L1 antibody (or immunocytokine) may be expressed in conjunction with electroporation, and optionally without any helper plasmids. In the Lonza expression system, the anti-PD-L1 antibody (or immunocytokine) may be expressed at a level of approximately 1 g/L, or approximately 900 mg/L, or approximately 800 mg/L, or approximately 700 mg/L. In another embodiment, In the Lonza expression system, the anti-PD-L1 antibody (or immunocytokine) may be expressed at a level of approximately 600 mg/L or approximately 500 mg/L or approximately 400 mg/L. In the Lonza expression system, the anti-PD-L1 antibody (or immunocytokine) may be expressed at a level of between approximately 400 mg/L and approximately 2 g/L, for example between approximately 500 mg/L and approximately 1.5 g/L, or between approximately 500 mg/L and approximately 1 g/L. In another embodiment, the expression level is above 1 g/L. In another embodiment, the anti-PD-L1 antibodies described in the concepts provide improved half-life over other anti-PD-L1 antibodies as further described in Aspect 1 hereinbelow.

Concept 2. The antibody or fragment according to concept 1, wherein $X_1$ is a hydroxyl-containing amino acid, optionally T.

In one embodiment, the hydroxyl-containing amino acid is Serine. In one embodiment, the hydroxyl-containing amino acid is Cysteine. In one embodiment, the hydroxyl-containing amino acid is Threonine. In one embodiment, the hydroxyl-containing amino acid is Methionine. In one embodiment, the hydroxyl-containing amino acid is Serine or Cysteine. In one embodiment, the hydroxyl-containing amino acid is Serine or Threonine. In one embodiment, the hydroxyl-containing amino acid is Serine or Methionine. In one embodiment, the hydroxyl-containing amino acid is Cysteine or Threonine. In one embodiment, the hydroxyl-containing amino acid is Cysteine or Methionine. In one embodiment, the hydroxyl-containing amino acid is Threonine or Methionine.

In one embodiment, the hydroxyl-containing amino acid is selected from serine, cysteine, threonine and methionine.

Concept 2a. The antibody or fragment according to concept 1a, wherein $X_1$ is an aliphatic amino acid or an amide amino acid.

In one embodiment, $X_1$ is selected from Asparagine (N) and valine (V). In one embodiment, $X_1$ is valine. In one embodiment, $X_1$ is asparagine.

Concept 2b. The antibody or fragment according to concept 1b, wherein $X_1$ is an aliphatic amino acid.

In one embodiment, $X_1$ is selected from alanine (A) or valine (V). In one embodiment, $X_1$ is valine. In one embodiment, $X_1$ is alanine.

Concept 3. The antibody or fragment according to concept 1 or concept 2, wherein $X_2$ is a basic amino acid, optionally K.

In one embodiment, the hydroxyl-containing amino acid is Histidine. In one embodiment, the hydroxyl-containing amino acid is Lysine. In one embodiment, the hydroxyl-containing amino acid is Arginine. In one embodiment, the hydroxyl-containing amino acid is Histidine or Lysine. In one embodiment, the hydroxyl-containing amino acid is Histidine or Arginine. In one embodiment, the hydroxyl-containing amino acid is Lysine or Arginine.

In one embodiment, the hydroxyl-containing amino acid is selected from Histidine, Lysine and Arginine.

Concept 3a. The antibody or fragment according to concept 1a or concept 2a, wherein $X_2$ is an aliphatic amino acid or an amide amino acid.

In one embodiment, $X_2$ is selected from leucine (L), isoleucine (I), Valine (V), Asparagine (N) and glutamine (Q). In one embodiment, $X_2$ is selected from leucine (L), isoleucine (I) and Valine (V). In one embodiment, $X_2$ is selected from Asparagine (N) and glutamine (Q) In one embodiment, $X_2$ is selected from leucine (L) and glutamine (Q). In one embodiment, $X_2$ is leucine (L). In one embodiment, $X_2$ is glutamine (Q).

Concept 4. The antibody or fragment according to any one of concepts 1 to 3, wherein $X_2$ is a hydroxyl-containing amino acid, optionally S or T.

In one embodiment, the hydroxyl-containing amino acid is Serine. In one embodiment, the hydroxyl-containing amino acid is Cysteine. In one embodiment, the hydroxyl-containing amino acid is Threonine. In one embodiment, the hydroxyl-containing amino acid is Methionine. In one embodiment, the hydroxyl-containing amino acid is Serine or Cysteine. In one embodiment, the hydroxyl-containing amino acid is Serine or Threonine. In one embodiment, the hydroxyl-containing amino acid is Serine or Methionine. In one embodiment, the hydroxyl-containing amino acid is Cysteine or Threonine. In one embodiment, the hydroxyl-containing amino acid is Cysteine or Methionine. In one embodiment, the hydroxyl-containing amino acid is Threonine or Methionine.

In one embodiment, the hydroxyl-containing amino acid is selected from serine, cysteine, threonine and methionine.

Concept 4a. The antibody or fragment according to any one of concepts 1a, 2a or 3a, wherein $X_3$ is an aromatic amino acid.

In one embodiment, $X_3$ is selected from Phenylalanine (F), Tyrosine (Y) and Tryptophan (W). In one embodiment, $X_3$ is selected from Tyrosine (Y) and Tryptophan (W). In one embodiment, $X_3$ is Tyrosine (Y). In one embodiment, $X_3$ is Tryptophan (W).

Concept 5. The antibody or fragment according to any one of concepts 1 to 4, wherein $X_3$ is an aromatic amino acid, optionally W.

In one embodiment, the hydroxyl-containing amino acid is Phenylalanine. In one embodiment, the hydroxyl-containing amino acid is Tyrosine. In one embodiment, the hydroxyl-containing amino acid is Tryptophan. In one embodiment, the hydroxyl-containing amino acid is Phenylalanine or Tyrosine. In one embodiment, the hydroxyl-containing amino acid is Phenylalanine or Tryptophan. In one embodiment, the hydroxyl-containing amino acid is Tyrosine or Tryptophan.

In one embodiment, the hydroxyl-containing amino acid is selected from Phenylalanine, Tyrosine and Tryptophan.

Concept 5a. The antibody or fragment according to any one of concepts 1a, 2a, 3a or 4a wherein $X_4$ is an aromatic amino acid.

In one embodiment, $X_4$ is selected from Phenylalanine (F), Tyrosine (Y) and Tryptophan (W). In one embodiment, $X_4$ is selected from Tyrosine (Y) and Phenylalanine (F). In one embodiment, $X_4$ is Tyrosine (Y). In one embodiment, $X_4$ is Phenylalanine (F).

Concept 6. The antibody or fragment according to any one of concepts 1 to 5, wherein $X_4$ is absent.

Concept 6a. The antibody or fragment according to any one of concepts 1a, 2a, 3a, 4a or 5a wherein $X_5$ is an aliphatic amino acid or an hydroxyl-containing amino acid.

In one embodiment, $X_5$ is selected from leucine (L), isoleucine (I), Valine (V), Serine (S), Cysteine (C) and Threonine (T). In one embodiment, $X_5$ is selected from leucine (L), isoleucine (I) and Valine (V). In one embodiment, $X_5$ is selected from Serine (S), Cysteine (C) and Threonine (T). In one embodiment, $X_5$ is selected from leucine (L) and Serine (S). In one embodiment, $X_5$ is Serine (S). In one embodiment, $X_5$ is leucine (L).

Concept 7. The antibody or fragment according to any one of concepts 1 to 5, wherein $X_4$ is present.

Concept 8. The antibody or fragment according to concept 7, wherein $X_4$ is an aliphatic amino acid, optionally G.

In one embodiment, the hydroxyl-containing amino acid is selected from Glycine, Alanine, Valine, Leucine and Isoleucine.

In one embodiment, the hydroxyl-containing amino acid is selected from Glycine and Alanine. In one embodiment, the hydroxyl-containing amino acid is selected from Glycine and Valine. In one embodiment, the hydroxyl-containing amino acid is selected from Glycine and Leucine. In one embodiment, the hydroxyl-containing amino acid is selected from Glycine and Isoleucine. In one embodiment, the hydroxyl-containing amino acid is selected from Alanine and Valine. In one embodiment, the hydroxyl-containing amino acid is selected from Alanine and Leucine. In one embodiment, the hydroxyl-containing amino acid is selected from Alanine and Isoleucine. In one embodiment, the hydroxyl-containing amino acid is selected from Valine and Leucine. In one embodiment, the hydroxyl-containing amino acid is selected from Valine and Isoleucine. In one embodiment, the hydroxyl-containing amino acid is selected from, Leucine and Isoleucine.

In one embodiment, the hydroxyl-containing amino acid selected from three of each of Glycine, Alanine, Valine, Leucine and Isoleucine. In one embodiment, the hydroxyl-containing amino acid selected from four of each of Glycine, Alanine, Valine, Leucine and Isoleucine.

Concept 9. An antibody or a fragment thereof, optionally according to any one of concepts 1 to 8, which specifically binds to hPD-L1, and competes for binding to said hPD-L1 with the antibody 1D05, wherein the antibody or fragment comprises a $V_H$ domain which comprises the CDRH3 sequence of SEQ ID NO:29 or 32, or the CDRH3 sequence of SEQ ID NO:29 or 32 comprising 6 or fewer amino acid substitutions.

Concept 9a: An antibody or a fragment thereof, optionally according to any one of concepts 1 to 8, which specifically binds to hPD-L1, and competes for binding to said hPD-L1 with the antibody 84G09, wherein the antibody or fragment comprises a $V_H$ domain which comprises the CDRH3 sequence of SEQ ID NO:9 or 12, or the CDRH3 sequence of SEQ ID NO:9 or 12 comprising 6 or fewer amino acid substitutions.

Concept 9b: An antibody or a fragment thereof, optionally according to any one of concepts 1 to 8, which specifically binds to hPD-L1, and competes for binding to said hPD-L1 with the antibody 411B08, wherein the antibody or fragment comprises a $V_H$ domain which comprises the CDRH3 sequence of SEQ ID NO:54 or 57, or the CDRH3 sequence of SEQ ID NO:54 or 57 comprising 6 or fewer amino acid substitutions.

Concept 9c: An antibody or a fragment thereof, optionally according to any one of concepts 1 to 8, which specifically binds to hPD-L1, and competes for binding to said hPD-L1 with the antibody 411C04, wherein the antibody or fragment comprises a $V_H$ domain which comprises the CDRH3 sequence of SEQ ID No:74 or 77, or the CDRH3 sequence of SEQ ID NO:74 or 77 comprising 6 or fewer amino acid substitutions.

Concept 9d: An antibody or a fragment thereof, optionally according to any one of concepts 1 to 8, which specifically binds to hPD-L1, and competes for binding to said hPD-L1 with the antibody 411D07, wherein the antibody or fragment comprises a $V_H$ domain which comprises the CDRH3 sequence of SEQ ID NO:94 or 97, or the CDRH3 sequence of SEQ ID NO:94 or 97 comprising 3 or fewer amino acid substitutions.

Concept 9e: An antibody or a fragment thereof, optionally according to any one of concepts 1 to 8, which specifically binds to hPD-L1, and competes for binding to said hPD-L1 with the antibody 385F01, wherein the antibody or fragment comprises a $V_H$ domain which comprises the CDRH3 sequence of SEQ ID NO:114 or 117, or the CDRH3 sequence of SEQ ID NO:114 or 117 comprising 6 or fewer amino acid substitutions.

Concept 9f: An antibody or a fragment thereof, optionally according to any one of concepts 1 to 8, which specifically binds to hPD-L1, and competes for binding to said hPD-L1 with the antibody 386H03, wherein the antibody or fragment comprises a $V_H$ domain which comprises the CDRH3 sequence of SEQ ID NO:144 or 147, or the CDRH3 sequence of SEQ ID NO:144 or 147 comprising 3 or fewer amino acid substitutions.

Concept 9g: An antibody or a fragment thereof, optionally according to any one of concepts 1 to 8, which specifically binds to hPD-L1, and competes for binding to said hPD-L1 with the antibody 389A03, wherein the antibody or fragment comprises a $V_H$ domain which comprises the CDRH3 sequence of SEQ ID NO:174 or 177, or the CDRH3 sequence of SEQ ID NO:174 or 177 comprising 6 or fewer amino acid substitutions.

Concept 9h: An antibody or a fragment thereof, optionally according to any one of concepts 1 to 8, which specifically binds to hPD-L1, and competes for binding to said hPD-L1 with the antibody 413D08, wherein the antibody or fragment comprises a $V_H$ domain which comprises the CDRH3 sequence of SEQ ID NO:134 or 137, or the CDRH3 sequence of SEQ ID NO:134 or 137 comprising 5 or fewer amino acid substitutions.

Concept 9i: An antibody or a fragment thereof, optionally according to any one of concepts 1 to 8, which specifically binds to hPD-L1, and competes for binding to said hPD-L1 with the antibody 413G05, wherein the antibody or fragment comprises a $V_H$ domain which comprises the CDRH3 sequence of SEQ ID NO:240 or 243, or the CDRH3 sequence of SEQ ID NO:240 or 243 comprising 6 or fewer amino acid substitutions.

Concept 9j: An antibody or a fragment thereof, optionally according to any one of concepts 1 to 8, which specifically binds to hPD-L1, and competes for binding to said hPD-L1 with the antibody 413F09, wherein the antibody or fragment comprises a $V_H$ domain which comprises the CDRH3 sequence of SEQ ID NO:260 or 263, or the CDRH3 sequence of SEQ ID NO:260 or 263 comprising 6 or fewer amino acid substitutions.

Concept 9k: An antibody or a fragment thereof, optionally according to any one of concepts 1 to 8, which specifically binds to hPD-L1, and competes for binding to said hPD-L1 with the antibody 414B06, wherein the antibody or fragment comprises a $V_H$ domain which comprises the CDRH3 sequence of SEQ ID NO:280 or 283, or the CDRH3 sequence of SEQ ID NO:280 or 283 comprising 6 or fewer amino acid substitutions.

Concept 9l: An antibody or a fragment thereof, optionally according to any one of concepts 1 to 8, which specifically binds to hPD-L1, and competes for binding to said hPD-L1 with the antibody 416E01, wherein the antibody or fragment comprises a $V_H$ domain which comprises the CDRH3 sequence of SEQ ID No:345 or 348, or the CDRH3 sequence of SEQ ID No:345 or 348 comprising 6 or fewer amino acid substitutions.

In all of concepts 9, 9a to l, 17, 17a to l, 18, 18a to l, 19, 19a to l, 22, 22a to l, 23, 23a to l, 24 and 24a to l, in one embodiment, the CDR comprises one amino acid substitution, which may be a conservative amino acid substitution. In all of concepts 9, 9a to l, 17, 17a to l, 18, 18a to l, 19, 19a to l, 22, 22a to l, 23, 23a, 24 and 24a to l, in one embodiment, the CDR comprises two amino acid substitutions, which may be conservative amino acid substitutions. In all of concepts 9, 9a to l, 17, 17a to l, 18, 18a to l, 19, 19a to l, 22, 22a, 22b, 22d, 22f, 22g, 24 and 24a to l, in one embodiment, the CDR comprises three amino acid substitutions, which may be conservative amino acid substitutions. In all of concepts 9, 9a to c, 9e, 9g to l, 17, 17a to c, 17e, 17g to l, 19, 19a, 22, 22d, 22f, 22g, 24 and 24a to l, in one embodiment, the CDR comprises four amino acid substitutions, which may be conservative amino acid substitutions. In all of concepts 9, 9a to c, 9e, 9g to l, 17, 17a to c, 17e, 17g to l, 22d, 22f and 22g, in one embodiment, the CDR comprises five amino acid substitutions, which may be conservative amino acid substitutions. In all of concepts 9, 9a to c, 9e, 9g, 9i to l, 17, 17a to c, 17e, 17g and 17i to l, in one embodiment, the CDR comprises six amino acid substitutions, which may be conservative amino acid substitutions.

Amino acid substitutions include alterations in which an amino acid is replaced with a different naturally-occurring amino acid residue. Such substitutions may be classified as "conservative", in which case an amino acid residue contained in a polypeptide is replaced with another naturally occurring amino acid of similar character either in relation to polarity, side chain functionality or size. Such conservative substitutions are well known in the art. Substitutions encompassed by the present invention may also be "non-conservative", in which an amino acid residue which is present in a peptide is substituted with an amino acid having different properties, such as naturally-occurring amino acid from a different group (e.g. substituting a charged or hydrophobic amino; acid with alanine), or alternatively, in which a naturally-occurring amino acid is substituted with a non-conventional amino acid.

In one embodiment, the conservative amino acid substitutions are as described herein. For example, the substitution may be of Y with F, T with S or K, P with A, E with D or Q, N with D or G, R with K, G with N or A, T with S or K, D with N or E, I with L or V, F with Y, S with T or A, R with K, G with N or A, K with R, A with S, K or P. In another embodiment, the conservative amino acid substitutions may be wherein Y is substituted with F, T with A or S, I with L or V, W with Y, M with L, N with D, G with A, T with A or S, D with N, I with L or V, F with Y or L, S with A or T and A with S, G, T or V.

Concept 10. An antibody or fragment which specifically binds to hPD-L1 and comprises a $V_H$ domain comprising a CDRH3 of from 12 to 20 amino acids and which is derived from the recombination of a human $V_H$ gene segment, a human D gene segment and a human $J_H$ gene segment, wherein the human $J_H$ gene segment is IGHJ5 (e.g. IGHJ5*02).

In one embodiment, the CDRH3 is from 14 to 17 amino acids and the human $J_H$ gene segment is IGHJ5 (e.g. IGHJ5*02).

There is also provided as concept 10a an antibody or fragment which specifically binds to hPD-L1 and comprises a $V_H$ domain comprising a CDRH3 of from 8 to 16 amino acids and which is derived from the recombination of a human $V_H$ gene segment, a human D gene segment and a human $J_H$ gene segment, wherein the human $J_H$ gene segment is selected from IGHJ4 (e.g. IGHJ4*02), IGHJ5 (e.g. IGHJ5*02) and IGHJ6 (e.g. IGHJ6*02).

In another embodiment, the human $J_H$ gene segment is IGHJ6 (e.g. IGHJ6*02). In another embodiment, the CDRH3 is of from 10 to 17 amino acids and the human $J_H$ gene segment is IGHJ6 (e.g. IGHJ6*02).

In another embodiment, the human $J_H$ gene segment is IGHJ4 (e.g. IGHJ4*02). In another embodiment, the CDRH3 is from 7 to 17 amino acids and the human $J_H$ gene segment is IGHJ4 (e.g. IGHJ4*02).

Optionally, the antibody of concept 10 or 10a has any of the features of concepts 1 to 9, including the binding affinities, Kon and Koff rates, expression levels, half-life etc.

Concept 11. The antibody or fragment according to concept 10 or 10a, wherein the human $V_H$ gene segment is IGHV3 (e.g. IGHV3-9, such as IGHV3-9*01).

There is also provided as concept 11a an antibody or fragment according to concept 10 or 10a, wherein the human $V_H$ gene segment is selected from IGHV3 (e.g. IGHV3-9, such as IGHV3-9*01 or e.g. IGHV3-7, such as IGHV3-7*01 or e.g. IGHV3-33, such as IGHV3-33*01 or e.g. IGHV3-11, such as IGHV3-11*01 or e.g. IGHV3-23, such as IGHV3-23*04), or IGHV4 (e.g. IGHV4-4, such as IGHV4-4*02 or e.g. IGHV4-39, such as IGHV4-39*01).

In one embodiment, the human $V_H$ gene segment is IGHV3 (e.g. IGHV3-7, such as IGHV3-7*01). In one embodiment, the human $V_H$ gene segment is IGHV3 (e.g. IGHV3-33, such as IGHV3-33*01). In one embodiment, the human $V_H$ gene segment is IGHV3 (e.g. IGHV3-11, such as IGHV3-11*01). In one embodiment, the human $V_H$ gene segment is IGHV3 (e.g. IGHV3-23, such as IGHV3-23*04).

In one embodiment, the human $V_H$ gene segment is IGHV4 (e.g. e.g. IGHV4-4, such as IGHV4-4*02). In one embodiment, the human $V_H$ gene segment is IGHV4 (e.g. IGHV4-39, such as IGHV4-39*01).

There is also provided as concept 11b an antibody or fragment according to concept 10, 10a, 11 or 11a, wherein the human D gene segment is selected from IGHD1 (e.g. IGHD1-20, such as IGHD1-20*01), IGHD3 (e.g. IGHD3-10, such as IGHD3-10*01), IGHD4 (e.g. IGHD4-11, such as IGHD4-11*01), IGHD5 (e.g. IGHD5-7, such as IGHD5-18*01), and IGHD6 (e.g. IGHD6-13, such as IGHD6-13*01).

In one embodiment, the human D gene segment is IGHD1 (e.g. IGHD1-20, such as IGHD1-20*01). In one embodiment, the human D gene segment is IGHD3 (e.g. IGHD3-10, such as IGHD3-10*01). In one embodiment, the human D gene segment is IGHD4 (e.g. IGHD4-11, such as IGHD4-11*01). In one embodiment, the human D gene segment is IGHD5 (e.g. IGHD5-18, such as IGHD5-19*01). In one embodiment, the human D gene segment is IGHD6 (e.g. IGHD6-13, such as IGHD6-13*01).

In any of concepts 10, 11 and 11a, the $V_H$, $D_H$ and $J_H$ gene segments are as described in the combinations for the antibodies in Table 5 hereinbelow. In one embodiment, the antibody heavy chain is derived from a combination of IGHV3 (e.g. IGHV3-7 such as IGHV3-7*01), IGHD4 (e.g. IGHD4-11 such as IGHD4-11*01) and IGHJ4 (e.g. IGHJ4*02). In one embodiment, the antibody heavy chain is derived from a combination of IGHV4 (e.g. IGHV4-4 such as IGHV4-4*02), IGHD3 (e.g. IGHD3-10 such as IGHD3-10*01) and IGHJ4 (e.g. IGHJ4*02). In one embodiment, the antibody heavy chain is derived from a combination of IGHV4 (e.g. IGHV4-39 such as IGHV4-39*01), IGHD6 (e.g. IGHD6-13 such as IGHD6-13*01) and IGHJ1 (e.g. IGHJ1*01). In one embodiment, the antibody heavy chain is derived from a combination of IGHV3 (e.g. IGHV3-33 such as IGHV3-33*01), IGHD5 (e.g. IGHD5-18 such as IGHD5-18*01) and IGHJ6 (e.g. IGHJ6*02). In one embodiment, the antibody heavy chain is derived from a combination of IGHV3 (e.g. IGHV3-11 such as IGHV3-11*01), IGHD1

(e.g. IGHD1-20 such as IGHD1-20*01) and IGHJ6 (e.g. IGHJ6*02). In one embodiment, the antibody heavy chain is derived from a combination of IGHV3 (e.g. IGHV3-23 such as IGHV3-23*04), IGHD5 (e.g. IGHD5-18 such as IGHD5-18*01) and IGHJ4 (e.g. IGHJ4*02). In one embodiment, the antibody heavy chain is derived from a combination of IGHV3 (e.g. IGHV3-7 such as IGHV3-7*01), IGHD5 (e.g. IGHD5-24 such as IGHD5-24*01) and IGHJ4 (e.g. IGHJ4*02). In one embodiment, the antibody heavy chain is derived from a combination of IGHV3 (e.g. IGHV3-23 such as IGHV3-23*04), IGHD6 (e.g. IGHD6-13 such as IGHD6-13*01) and IGHJ4 (e.g. IGHJ4*02).

Concept 12. The antibody or fragment according to concept 10, 10a, 11, 11a or 11b, wherein the antibody or fragment comprises a $V_L$ domain which is derived from the recombination of a human Vκ gene segment, and a human Jκ gene segment, wherein the human Vκ gene segment is IGκV1D (e.g. IGκV1D-39, such as IGκV1D-39*01).

There is also provided as concept 12a an antibody or fragment according to any of concepts 10, 10a, 11, 11a or 11b, wherein the human Vκ gene segment is selected from IGκV1 (e.g. IGκV1-17, such as IGκV1-17*01 or e.g. IGκV1-9, such as IGκV1-9*d01 or e.g. IGκV1D-12, such as IGκV1D-12*02 or e.g. IGκV1D-39, such as IGκV1D-39*01), and IGκV4 (e.g. IGκV4-1, such as IGκV4-1*01).

In one embodiment, the human Vκ gene segment is IGκV1 (e.g. IGκV1-17, such as IGκV1-17*01). In one embodiment, the human Vκ gene segment is IGκV1 (e.g. IGκV1-9, such as IGκV1-9*d01). In one embodiment, the human Vκ gene segment is IGκV1 (e.g. IGκV1D-12, such as IGκV1D-12*02). In one embodiment, the human Vκ gene segment is IGκV1 (e.g. IGκV1D-39, such as IGκV1D-39*01).

In one embodiment, the human Vκ gene segment is IGκV1 IGκV4 (e.g. IGκV4-1, such as IGκV4-1*01)

There is also provided as concept 12b an antibody or fragment according to concept 10, 10a, 11 or 11a, wherein the human Jκ gene segment is selected from IGκJ1 (e.g. IGκJ1*01), IGκJ2 (e.g. IGκJ2*04), IGκJ3 (e.g. IGκJ3*01), IGκJ4 (e.g. IGκJ4*01) or IGκJ5 (e.g. IGκJ5*01).

In one embodiment, the human Jκ gene segment is IGκJ1 (e.g. IGκJ1*01). In one embodiment, the human Jκ gene segment is IGκJ2 (e.g. IGκJ2*04). In one embodiment, the human Jκ gene segment is IGκJ3 (e.g. IGκJ3*01). In one embodiment, the human Jκ gene segment is IGκJ4 (e.g. IGκJ4*01). In one embodiment, the human Jκ gene segment is IGκJ5 (e.g. IGκJ5*01).

In any of concepts 12 and 12a, the Vκ and Jκ gene segments are as described in the combinations for the antibodies in Table 5 hereinbelow. In one embodiment, the antibody light chain is derived from a combination of IGKV1D (e.g. IGKV1D-12 such as IGKV1D-12*02) and IGKJ3 (e.g. IGKJ3*01). In one embodiment, the antibody light chain is derived from a combination of IGKV4 (e.g. IGKV4-1 such as IGKV14-1*01) and IGKJ2 (e.g. IGKJ2*04). In one embodiment, the antibody light chain is derived from a combination of IGKV1 (e.g. IGKV1-17 such as IGKV1-17*01) and IGKJ1 (e.g. IGKJ1*01). In one embodiment, the antibody light chain is derived from a combination of IGKV1D (e.g. IGKV1D-12 such as IGKV1D-12*02) and IGKJ4 (e.g. IGKJ4*01). In one embodiment, the antibody light chain is derived from a combination of IGKV1 (e.g. IGKV1-9 such as IGKV1-9*d01) and IGKJ5 (e.g. IGKJ5*01). In one embodiment, the antibody light chain is derived from a combination of IGKV1D (e.g. IGKV1D-12 such as IGKV1D-12*02) and IGKJ5 (e.g. IGKJ5*01).

Concept 13. An antibody or fragment thereof which specifically binds to an epitope that is identical to an epitope to which the antibody 1D05 specifically binds.

Concept 13a. An antibody or fragment thereof which specifically binds to an epitope that is identical to an epitope to which the antibody 84G09 specifically binds.

Concept 13b. An antibody or fragment thereof which specifically binds to an epitope that is identical to an epitope to which the antibody 411B08 specifically binds.

Concept 13c. An antibody or fragment thereof which specifically binds to an epitope that is identical to an epitope to which the antibody 411C04 specifically binds.

Concept 13d. An antibody or fragment thereof which specifically binds to an epitope that is identical to an epitope to which the antibody 411D07 specifically binds.

Concept 13e. An antibody or fragment thereof which specifically binds to an epitope that is identical to an epitope to which the antibody 385F01 specifically binds.

Concept 13f. An antibody or fragment thereof which specifically binds to an epitope that is identical to an epitope to which the antibody 386H03 specifically binds.

Concept 13g. An antibody or fragment thereof which specifically binds to an epitope that is identical to an epitope to which the antibody 389A03 specifically binds.

Concept 13h. An antibody or fragment thereof which specifically binds to an epitope that is identical to an epitope to which the antibody 413D08 specifically binds.

Concept 13i. An antibody or fragment thereof which specifically binds to an epitope that is identical to an epitope to which the antibody 413G05 specifically binds.

Concept 13j. An antibody or fragment thereof which specifically binds to an epitope that is identical to an epitope to which the antibody 413F09 specifically binds.

Concept 13k. An antibody or fragment thereof which specifically binds to an epitope that is identical to an epitope to which the antibody 414B06 specifically binds.

Concept 13l. An antibody or fragment thereof which specifically binds to an epitope that is identical to an epitope to which the antibody 416E01 specifically binds.

The antibodies described in these concepts have the sequences as described hereinabove.

In one embodiment, there is provided an antibody which specifically binds to an epitope which is substantially similar to an epitope to which any of the antibodies in concept 13, 13 a to 13l bind.

Contact amino acid residues involved in the interaction of antibody and antigen may be determined by various known methods to those skilled in the art.

In one embodiment, sequential replacement of the amino acids of the antigen sequence (using standard molecular biology techniques to mutate the DNA of the coding sequence of the antigen), in this case hPD-L1 with Alanine (a.k.a Alanine scan), or another unrelated amino acid, may provide residues whose mutation would reduce or ablate the ability of the antibody to recognise the antigen in question. Binding may be assessed using standard techniques, such as, but not limited to, SPR, HTRF, ELISA (which are described elsewhere herein). Other substitutions could be made to enhance the disruption of binding such as changing the charge on the side chain of antigen sequence amino acids (e.g. Lysine change to glutamic acid), switching polar and non-polar residues (e.g. Serine change to leucine). The alanine scan or other amino substitution method may be carried out either with recombinant soluble antigen, or where the target is a cell membrane target, directly on cells using transient or stable expression of the mutated versions.

In one embodiment, protein crystallography may be used to determine contact residues between antibody and antigen (i.e. to determine the epitope to which the antibody binds), crystallography allows the direct visualisation of contact residues involved in the antibody-antigen interaction. As well as standard X-ray crystallography, cryo-electro microscopy has been used to determine contact residues between antibodies and HIV capsid protein (see Lee, Jeong Hyun, et al. "Antibodies to a conformational epitope on gp41 neutralize HIV-1 by destabilizing the Env spike.", Nature communications, 6, (2015)).

In one embodiment, if the antibody recognises a linear epitope, short peptides based on the antigen sequence can be produced and binding of the antibody to these peptides can be assessed using standard techniques, such as, but not limited to, SPR, HTRF, ELISA (which are described elsewhere herein). Further investigation of the epitope could be provided by performing an Alanine scan on any peptides that show binding. Alternative to linear peptides, conformational scans could be carried out using Pepscan technology (pepscan.com/) using their chemical linkage of peptides onto scaffolds, which has been used to determine discontinuous epitopes on CD20 targeting antibodies (Niederfellner, Gerhard, et al. "Epitope characterization and crystal structure of GA101 provide insights into the molecular basis for type I/II distinction of CD20 antibodies.", Blood, 118.2, (2011), 358-367.).

In one embodiment, limited proteolytic digestion and mass spectrophotometry can be used to identify binding epitopes. The antibody-antigen complex is digested by a protease, such as, but not limited to, trypsin. The digested complex peptides are compared to antibody-alone and antigen-alone digestion mass spectrophotometry to determine if a particular epitope is protected by the complexation. Further work involving amino acid substitution, competition binding, may then be employed to narrow down to individual amino acid residues involved in the interaction (see, for example, Suckau, Detlev, et al "Molecular epitope identification by limited proteolysis of an immobilized antigen-antibody complex and mass spectrometric peptide mapping.", Proceedings of the National Academy of Sciences, 87.24, (1990), 9848-9852).

Thus, in one embodiment, the contact residues of the epitope are identified with an unrelated amino acid scan (e.g. alanine scan). In another embodiment, an unrelated amino acid scan (e.g. alanine scan) is carried out using a technique selected from SPR, HTRF, ELISA, X-ray crystallography, cryo-electro microscopy and a combination of limited proteolytic digestion and mass spectrometry. In one embodiment, the unrelated amino acid scan (e.g. alanine scan) is carried out using HTRF. In one embodiment, the unrelated amino acid scan (e.g. alanine scan) is carried out using ELISA.

When the alanine scan is carried out with either ELISA or HTRF, an amino acid residue is identified as contributing to the epitope if the reduction in signal is at least 25%. In one embodiment, the reduction in signal is at least 30%. In one embodiment, the reduction in signal is at least 35%. In one embodiment, the reduction in signal is at least 40%. In one embodiment, the reduction in signal is at least 45%. In one embodiment, the reduction in signal is at least 50%. In one embodiment, the reduction in signal is at least 55%. In one embodiment, the reduction in signal is at least 60%. In one embodiment, the reduction in signal is at least 70%. In one embodiment, the reduction in signal is at least 75%. In one embodiment, the reduction in signal is at least 80%. In one embodiment, the reduction in signal is at least 85%. In one embodiment, the reduction in signal is at least 90%.

When the alanine scan is carried out with SPR, an amino acid residue is identified as contributing to the epitope if there is at least a 10-fold reduction in affinity. In one embodiment, the reduction in affinity is at least 15-fold. In one embodiment, the reduction in affinity is at least 20-fold. In one embodiment, the reduction in affinity is at least 30-fold. In one embodiment, the reduction in affinity is at least 40-fold. In one embodiment, the reduction in affinity is at least 50-fold. In one embodiment, the reduction in affinity is at least 100-fold.

In one embodiment, the contact residues of the epitope are identified by X-ray crystallography. In one embodiment, the contact residues of the epitope are identified by cryo-electro microscopy. In one embodiment, the contact residues of the epitope are identified by a combination of limited proteolytic digestion and mass spectrometry.

Concept 14. The antibody or fragment according to concept 13, wherein the epitope is identified by unrelated amino acid scanning, or by X-ray crystallography.

Concept 15. The antibody or fragment according to concept 14, wherein the contact residues of the epitope are defined by a reduction in affinity of at least 10-fold in an unrelated amino acid scan, e.g. an alanine scan as determined by SPR.

In one embodiment, the reduction in affinity is at least 15-fold. In one embodiment, the reduction in affinity is at least 20-fold. In one embodiment, the reduction in affinity is at least 30-fold. In one embodiment, the reduction in affinity is at least 40-fold. In one embodiment, the reduction in affinity is at least 50-fold. In one embodiment, the reduction in affinity is at least 100-fold.

SPR may be carried out as described hereinabove.

Concept 16. An antibody or fragment thereof which competes for binding to hPD-L1 with the antibody 1D05.

Competition may be determined by surface plasmon resonance (SPR), such techniques being readily apparent to the skilled person. SPR may be carried out using Biacore™, Proteon™ or another standard SPR technique. Such competition may be due, for example, to the antibodies or fragments binding to identical or overlapping epitopes of hPD-L1. In one embodiment, competition is determined by ELISA, such techniques being readily apparent to the skilled person. In one embodiment, competition is determined by homogenous time resolved fluorescence (HTRF), such techniques being readily apparent to the skilled person. In one embodiment, competition is determined by fluorescence activated cell sorting (FACS), such techniques being readily apparent to the skilled person. In one embodiment, competition is determined by ForteBio Octet® Bio-Layer Interferometry (BLI) such techniques being readily apparent to the skilled person.

In one embodiment, the antibody or fragment competes (e.g. in a dose-dependent manner) with hPD-1 (or a fusion protein thereof) for binding to cell surface-expressed hPD-L1. In one embodiment, the antibody or fragment competes (e.g. in a dose-dependent manner) with hPD-1 (or a fusion protein thereof) for binding to soluble hPDL-1.

In one embodiment, the antibody or fragment partially or completely inhibits binding of PD-1 and/or CD80 to cell surface-expressed PD-L1, such as hPD-L1. In another embodiment, the antibody or fragment partially or completely inhibits binding of hPD-1 and/or CD80 to soluble hPD-L1. In some embodiments, the antibody or fragment partially or completely increases the secretion of IFNγ, CD25 and IL-2 from a cell having cell surface-expressed PD-1. In one embodiment, the antibody or fragment partially or completely inhibits binding of CD80 to soluble hPD-L1, but does not show any detectable inhibition of the binding of PD-1 to cell surface-expressed PD-L1. In one embodiment, the antibody or fragment partially or completely inhibits binding of CD80 to soluble hPD-L1, but does not show any detectable inhibition of the binding of PD-1 to soluble PD-L1.

As used herein, "inhibits", "inhibition", "inhibiting" and the like, as used herein refers to the ability of an antagonist (e.g. an antibody or fragment thereof) to bind to an epitope which either partially or completely prevents the binding of the receptor (e.g. CD80 or PD-1) to the ligand (e.g. PD-L1). If the epitope to which the antagonist binds completely blocks the binding site of the ligand, then ligand binding is completely prevented (which may be a physical blocking—in the case of overlapping epitopes—or steric blocking—where the antagonist is large such that it prevents the ligand binding to its distinct epitope), and the ligand is not removed from circulation. The concentration of circulating ligand may therefore appear to be increased. If the epitope to which the antagonist binds partially blocks the binding site of the ligand, the the ligand may be able to bind, but only weakly (in the case of partial inhibition), or in a different orientation to the natural binding interaction. In this case, some of the ligand may be removed from circulation, but not as much as when the ligand binding site is completely free and available for binding. Inhibition thus refers to the physical interaction of ligand and receptor. Inhibition can be measured by HTRF, which is described in more detail elsewhere herein and in Mathis (1995) Clinical Chemistry 41(9), 1391-1397. Inhibition can also be measured by flow cytometry, where receptor is expressed on cells, or by ELISA, where receptor is adsorbed onto plates.

Concept 16a. An antibody or fragment thereof which competes for binding to hPD-L1 with the antibody 84G09.

Concept 16b. An antibody or fragment thereof which competes for binding to hPD-L1 with the antibody 411B08.

Concept 16c. An antibody or fragment thereof which competes for binding to hPD-L1 with the antibody 411C04.

Concept 16d. An antibody or fragment thereof which competes for binding to hPD-L1 with the antibody 411D07.

Concept 16e. An antibody or fragment thereof which competes for binding to hPD-L1 with the antibody 385F01.

Concept 16f. An antibody or fragment thereof which competes for binding to hPD-L1 with the antibody 386H03.

Concept 16g. An antibody or fragment thereof which competes for binding to hPD-L1 with the antibody 389A03.

Concept 16h. An antibody or fragment thereof which competes for binding to hPD-L1 with the antibody 413D08.

Concept 16i. An antibody or fragment thereof which competes for binding to hPD-L1 with the antibody 413G05.

Concept 16j. An antibody or fragment thereof which competes for binding to hPD-L1 with the antibody 413F09.

Concept 16k. An antibody or fragment thereof which competes for binding to hPD-L1 with the antibody 414B06.

Concept 16l. An antibody or fragment thereof which competes for binding to hPD-L1 with the antibody 416E01.

The antibodies have the sequences as described hereinabove.

Concept 17. The antibody or fragment according to any one of concepts 10 to 16, wherein the $V_H$ domain comprises the CDRH3 sequence of SEQ ID NO:29 or 32, or the CDRH3 sequence of SEQ ID NO:29 or 32 comprising 6 or fewer amino acid substitutions.

Concept 17a: An antibody or a fragment thereof according to any one of concepts 10 to 16 (but when dependent on concept 13, it is dependent on concept 13a, and when dependent on concept 16, it is dependent on concept 16a), wherein the $V_H$ domain comprises the CDRH3 sequence of SEQ ID NO:9 or 12, or the CDRH3 sequence of SEQ ID NO:9 or 12 comprising 6 or fewer amino acid substitutions.

Concept 17b: An antibody or a fragment thereof according to any one of concepts 10 to 16 (but when dependent on concept 13, it is dependent on concept 13b, and when dependent on concept 16, it is dependent on concept 16b), wherein the $V_H$ domain comprises the CDRH3 sequence of SEQ ID NO:54 or 57, or the CDRH3 sequence of SEQ ID NO:54 or 57 comprising 6 or fewer amino acid substitutions.

Concept 17c: An antibody or a fragment thereof according to any one of concepts 10 to 16 (but when dependent on concept 13, it is dependent on concept 13c, and when dependent on concept 16, it is dependent on concept 16c), wherein the a $V_H$ domain comprises the CDRH3 sequence of SEQ ID NO:74 or 77, or the CDRH3 sequence of SEQ ID NO:74 or 77 comprising 6 or fewer amino acid substitutions.

Concept 17d: An antibody or a fragment thereof according to any one of concepts 10 to 16 (but when dependent on concept 13, it is dependent on concept 13d, and when dependent on concept 16, it is dependent on concept 16d), wherein the $V_H$ domain comprises the CDRH3 sequence of SEQ ID NO:94 or 97, or the CDRH3 sequence of SEQ ID NO:94 or 97 comprising 3 or fewer amino acid substitutions.

Concept 17e: An antibody or a fragment thereof according to any one of concepts 10 to 16 (but when dependent on concept 13, it is dependent on concept 13e, and when dependent on concept 16, it is dependent on concept 16e), wherein the $V_H$ domain comprises the CDRH3 sequence of SEQ ID NO:114 or 117, or the CDRH3 sequence of SEQ ID NO:114 or 117 comprising 6 or fewer amino acid substitutions.

Concept 17f: An antibody or a fragment thereof according to any one of concepts 10 to 16 (but when dependent on concept 13, it is dependent on concept 13f, and when dependent on concept 16, it is dependent on concept 16f), wherein the $V_H$ domain comprises the CDRH3 sequence of SEQ ID NO:144 or 147, or the CDRH3 sequence of SEQ ID NO:144 or 147 comprising 3 or fewer amino acid substitutions.

Concept 17g: An antibody or a fragment thereof according to any one of concepts 10 to 16 (but when dependent on concept 13, it is dependent on concept 13g, and when dependent on concept 16, it is dependent on concept 16g), wherein the $V_H$ domain comprises the CDRH3 sequence of SEQ ID NO:174 or 177, or the CDRH3 sequence of SEQ ID NO:174 or 177 comprising 6 or fewer amino acid substitutions.

Concept 17h: An antibody or a fragment thereof according to any one of concepts 10 to 16 (but when dependent on concept 13, it is dependent on concept 13h, and when dependent on concept 16, it is dependent on concept 16h), wherein the $V_H$ domain comprises the CDRH3 sequence of SEQ ID NO:134 or 137, or the CDRH3 sequence of SEQ ID NO:134 or 137 comprising 5 or fewer amino acid substitutions.

Concept 17i: An antibody or a fragment thereof according to any one of concepts 10 to 16 (but when dependent on concept 13, it is dependent on concept 13i, and when dependent on concept 16, it is dependent on concept 16i), wherein the $V_H$ domain comprises the CDRH3 sequence of SEQ ID NO:240 or 243, or the CDRH3 sequence of SEQ ID NO:240 or 243 comprising 6 or fewer amino acid substitutions.

Concept 17j: An antibody or a fragment thereof according to any one of concepts 10 to 16 (but when dependent on concept 13, it is dependent on concept 13j, and when dependent on concept 16, it is dependent on concept 16j), wherein the a $V_H$ domain comprises the CDRH3 sequence of SEQ ID NO:260 or 263, or the CDRH3 sequence of SEQ ID NO:260 or 263 comprising 6 or fewer amino acid substitutions.

Concept 17k: An antibody or a fragment thereof according to any one of concepts 10 to 16 (but when dependent on concept 13, it is dependent on concept 13k, and when dependent on concept 16, it is dependent on concept 16k), wherein the $V_H$ domain comprises the CDRH3 sequence of SEQ ID NO:280 or 283, or the CDRH3 sequence of SEQ ID NO:280 or 283 comprising 6 or fewer amino acid substitutions.

Concept 17l: An antibody or a fragment thereof according to any one of concepts 10 to 16 (but when dependent on concept 13, it is dependent on concept 13l, and when dependent on concept 16, it is dependent on concept 16l), wherein the $V_H$ domain comprises the CDRH3 sequence of SEQ ID NO:345 or 348, or the CDRH3 sequence of SEQ ID NO:345 or 348 comprising 6 or fewer amino acid substitutions.

Concept 18. The antibody or fragment according to any preceding concept, wherein the $V_H$ domain comprises the CDRH1 sequence of SEQ ID NO:27 or 30 or the CDRH1 sequence of SEQ ID NO:27 or 30 comprising 3, 2 or 1 amino acid substitution(s).

Concept 18a: An antibody or a fragment thereof according to any preceding concept (but when dependent on concept 9, it is dependent on concept 9a, when dependent on concept 13, it is dependent on concept 13a, when dependent on concept 16, it is dependent on concept 16a, and when dependent on concept 17, it is dependent on concept 17a), wherein the $V_H$ domain comprises the CDRH1 sequence of SEQ ID NO:7 or 10, or the CDRH1 sequence of SEQ ID NO:7 or 10 comprising 3, 2 or 1 amino acid substitution(s).

Concept 18b: An antibody or a fragment thereof according to any preceding concept (but when dependent on concept 9, it is dependent on concept 9b, when dependent on concept 13, it is dependent on concept 13b, when dependent on concept 16, it is dependent on concept 16b, and when dependent on concept 17, it is dependent on concept 17b), wherein the $V_H$ domain comprises the CDRH1 sequence of SEQ ID NO:52 or 55, or the CDRH1 sequence of SEQ ID NO:52 or 55 comprising 3, 2 or 1 amino acid substitution(s).

Concept 18c: An antibody or a fragment thereof according to any preceding concept (but when dependent on concept 9, it is dependent on concept 9c, when dependent on concept 13, it is dependent on concept 13c, when dependent on concept 16, it is dependent on concept 16c, and when dependent on concept 17, it is dependent on concept 17c), wherein the $V_H$ domain comprises the CDRH1 sequence of SEQ ID NO:72 or 75, or the CDRH1 sequence of SEQ ID NO:72 or 75 comprising 3, 2 or 1 amino acid substitution(s).

Concept 18d: An antibody or a fragment thereof according to any preceding concept (but when dependent on concept 9, it is dependent on concept 9d, when dependent on concept 13, it is dependent on concept 13d, when dependent on concept 16, it is dependent on concept 16d, and when dependent on concept 17, it is dependent on concept 17d), wherein the $V_H$ domain comprises the CDRH1 sequence of SEQ ID NO:92 or 95, or the CDRH1 sequence of SEQ ID NO:92 or 95 comprising 3, 2 or 1 amino acid substitution(s).

Concept 18e: An antibody or a fragment thereof according to any preceding concept (but when dependent on concept 9, it is dependent on concept 9e, when dependent on concept 13, it is dependent on concept 13e, when dependent on concept 16, it is dependent on concept 16e, and when dependent on concept 17, it is dependent on concept 17e), wherein the $V_H$ domain comprises the CDRH1 sequence of SEQ ID NO:112 or 115, or the CDRH1 sequence of SEQ ID NO:112 or 115 comprising 3, 2 or 1 amino acid substitution(s).

Concept 18f: An antibody or a fragment thereof according to any preceding concept (but when dependent on concept 9, it is dependent on concept 9f, when dependent on concept 13, it is dependent on concept 13f, when dependent on concept 16, it is dependent on concept 16f, and when dependent on concept 17, it is dependent on concept 17f), wherein the $V_H$ domain comprises the CDRH1 sequence of SEQ ID NO:142 or 145, or the CDRH1 sequence of SEQ ID NO:142 or 145 comprising 3, 2 or 1 amino acid substitution(s).

Concept 18g: An antibody or a fragment thereof according to any preceding concept (but when dependent on concept 9, it is dependent on concept 9g, when dependent on concept 13, it is dependent on concept 13g, when dependent on concept 16, it is dependent on concept 16g, and when dependent on concept 17, it is dependent on concept 17g), wherein the $V_H$ domain comprises the CDRH1 sequence of SEQ ID NO:172 or 175, or the CDRH1 sequence of SEQ ID NO:172 or 175 comprising 3, 2 or 1 amino acid substitution(s).

Concept 18h: An antibody or a fragment thereof according to any preceding concept (but when dependent on concept 9, it is dependent on concept 9h, when dependent on concept 13, it is dependent on concept 13h, when dependent on concept 16, it is dependent on concept 16h, and when dependent on concept 17, it is dependent on concept 17h), wherein the $V_H$ domain comprises the CDRH1 sequence of SEQ ID NO:132 or 135, or the CDRH1 sequence of SEQ ID NO:132 or 135 comprising 3, 2 or 1 amino acid substitution(s).

Concept 18i: An antibody or a fragment thereof according to any preceding concept (but when dependent on concept 9, it is dependent on concept 9i, when dependent on concept 13, it is dependent on concept 13i, when dependent on concept 16, it is dependent on concept 16i, and when dependent on concept 17, it is dependent on concept 17i), wherein the $V_H$ domain comprises the CDRH1 sequence of SEQ ID NO:238 or 241, or the CDRH1 sequence of SEQ ID NO:238 or 241 comprising 3, 2 or 1 amino acid substitution(s).

Concept 18j: An antibody or a fragment thereof according to any preceding concept (but when dependent on concept 9, it is dependent on concept 9j, when dependent on concept 13, it is dependent on concept 13j, when dependent on concept 16, it is dependent on concept 16j, and when dependent on concept 17, it is dependent on concept 17j), wherein the $V_H$ domain comprises the CDRH1 sequence of SEQ ID NO:258 or 261, or the CDRH1 sequence of SEQ ID NO:258 or 261 comprising 3, 2 or 1 amino acid substitution(s).

Concept 18k: An antibody or a fragment thereof according to any preceding concept (but when dependent on concept 9, it is dependent on concept 9k, when dependent on concept 13, it is dependent on concept 13k, when dependent on concept 16, it is dependent on concept 16k, and when dependent on concept 17, it is dependent on concept 17k), wherein the $V_H$ domain comprises the CDRH1 sequence of SEQ ID NO: 278 or 281, or the CDRH1 sequence of SEQ ID NO: 278 or 281 comprising 3, 2 or 1 amino acid substitution(s).

Concept 18l: An antibody or a fragment thereof according to any preceding concept (but when dependent on concept 9, it is dependent on concept 9l, when dependent on concept 13, it is dependent on concept 13l, when dependent on concept 16, it is dependent on concept 16l, and when dependent on concept 17, it is dependent on concept 17l), wherein the V$_H$ domain comprises the CDRH1 sequence of SEQ ID NO: 343 or 346, or the CDRH1 sequence of SEQ ID NO: 343 or 346 comprising 3, 2 or 1 amino acid substitution(s).

Concept 19. The antibody or fragment according to any preceding concept, wherein the V$_H$ domain comprises the CDRH2 sequence of SEQ ID NO:28 or 31, or the CDRH2 sequence of SEQ ID NO:28 or 31 comprising 4 or fewer amino acid substitutions.

Concept 19a: An antibody or a fragment thereof according to any preceding concept (but when dependent on concept 9, it is dependent on concept 9a, when dependent on concept 13, it is dependent on concept 13a, when dependent on concept 16, it is dependent on concept 16a, when dependent on concept 17, it is dependent on concept 17a, and when dependent on concept 18, it is dependent on concept 18a), wherein the V$_H$ domain comprises the CDRH2 sequence of SEQ ID NO:8 or 11, or the CDRH2 sequence of SEQ ID NO:8 or 11 comprising 4 or fewer amino acid substitutions.

Concept 19b: An antibody or a fragment thereof according to any preceding concept (but when dependent on concept 9, it is dependent on concept 9b, when dependent on concept 13, it is dependent on concept 13b, when dependent on concept 16, it is dependent on concept 16b, when dependent on concept 17, it is dependent on concept 17b, and when dependent on concept 18, it is dependent on concept 18b), wherein the V$_H$ domain comprises the CDRH2 sequence of SEQ ID NO:53 or 56, or the CDRH2 sequence of SEQ ID NO:53 or 56 comprising 3, 2 or 1 amino acid substitution(s).

Concept 19c: An antibody or a fragment thereof according to any preceding concept (but when dependent on concept 9, it is dependent on concept 9c, when dependent on concept 13, it is dependent on concept 13c, when dependent on concept 16, it is dependent on concept 16c, when dependent on concept 17, it is dependent on concept 17c, and when dependent on concept 18, it is dependent on concept 18c), wherein the V$_H$ domain comprises the CDRH2 sequence of SEQ ID NO:73 or 76, or the CDRH2 sequence of SEQ ID NO:73 or 76 comprising 3, 2 or 1 amino acid substitution(s).

Concept 19d: An antibody or a fragment thereof according to any preceding concept (but when dependent on concept 9, it is dependent on concept 9d, when dependent on concept 13, it is dependent on concept 13d, when dependent on concept 16, it is dependent on concept 16d, when dependent on concept 17, it is dependent on concept 17d, and when dependent on concept 18, it is dependent on concept 18d), wherein the V$_H$ domain comprises the CDRH2 sequence of SEQ ID NO:93 or 96, or the CDRH2 sequence of SEQ ID NO:93 or 96 comprising 3, 2 or 1 amino acid substitution(s).

Concept 19e: An antibody or a fragment thereof according to any preceding concept (but when dependent on concept 9, it is dependent on concept 9e, when dependent on concept 13, it is dependent on concept 13e, when dependent on concept 16, it is dependent on concept 16e, when dependent on concept 17, it is dependent on concept 17e, and when dependent on concept 18, it is dependent on concept 18e), wherein the V$_H$ domain comprises the CDRH2 sequence of SEQ ID NO:113 or 116, or the CDRH2 sequence of SEQ ID NO:113 or 116 comprising 3, 2 or 1 amino acid substitution(s).

Concept 19f: An antibody or a fragment thereof according to any preceding concept (but when dependent on concept 9, it is dependent on concept 9f, when dependent on concept 13, it is dependent on concept 13f, when dependent on concept 16, it is dependent on concept 16f, when dependent on concept 17, it is dependent on concept 17f, and when dependent on concept 18, it is dependent on concept 18f), wherein the V$_H$ domain comprises the CDRH2 sequence of SEQ ID NO:143 or 146, or the CDRH2 sequence of SEQ ID NO:143 or 146 comprising 3, 2 or 1 amino acid substitution(s).

Concept 19g: An antibody or a fragment thereof according to any preceding concept (but when dependent on concept 9, it is dependent on concept 9g, when dependent on concept 13, it is dependent on concept 13g, when dependent on concept 16, it is dependent on concept 16g, when dependent on concept 17, it is dependent on concept 17g, and when dependent on concept 18, it is dependent on concept 18g), wherein the V$_H$ domain comprises the CDRH2 sequence of SEQ ID NO:173 or 176, or the CDRH2 sequence of SEQ ID NO:173 or 176 comprising 3, 2 or 1 amino acid substitution(s).

Concept 19h: An antibody or a fragment thereof according to any preceding concept (but when dependent on concept 9, it is dependent on concept 9h, when dependent on concept 13, it is dependent on concept 13h, when dependent on concept 16, it is dependent on concept 16h, when dependent on concept 17, it is dependent on concept 17h, and when dependent on concept 18, it is dependent on concept 18h), wherein the V$_H$ domain comprises the CDRH2 sequence of SEQ ID NO:133 or 136, or the CDRH2 sequence of SEQ ID NO:133 or 136 comprising 3, 2 or 1 amino acid substitution(s).

Concept 19i: An antibody or a fragment thereof according to any preceding concept (but when dependent on concept 9, it is dependent on concept 9i, when dependent on concept 13, it is dependent on concept 13i, when dependent on concept 16, it is dependent on concept 16i, when dependent on concept 17, it is dependent on concept 17i, and when dependent on concept 18, it is dependent on concept 18i), wherein the V$_H$ domain comprises the CDRH2 sequence of SEQ ID NO:239 or 242, or the CDRH2 sequence of SEQ ID NO:239 or 242 comprising 3, 2 or 1 amino acid substitution(s).

Concept 19j: An antibody or a fragment thereof according to any preceding concept (but when dependent on concept 9, it is dependent on concept 9j, when dependent on concept 13, it is dependent on concept 13j, when dependent on concept 16, it is dependent on concept 16j, when dependent on concept 17, it is dependent on concept 17j, and when dependent on concept 18, it is dependent on concept 18j), wherein the V$_H$ domain comprises the CDRH2 sequence of SEQ ID NO:259 or 262, or the CDRH2 sequence of SEQ ID NO:259 or 262 comprising 3, 2 or 1 amino acid substitution(s).

Concept 19k: An antibody or a fragment thereof according to any preceding concept (but when dependent on concept 9, it is dependent on concept 9k, when dependent on concept 13, it is dependent on concept 13k, when dependent on concept 16, it is dependent on concept 16k, when dependent on concept 17, it is dependent on concept 17k, and when dependent on concept 18, it is dependent on concept 18k), wherein the V$_H$ domain comprises the CDRH2 sequence of SEQ ID NO:279 or 282, or the CDRH2 sequence of SEQ ID NO:279 or 282 comprising 3, 2 or 1 amino acid substitution(s).

Concept 19l: An antibody or a fragment thereof according to any preceding concept (but when dependent on concept 9, it is dependent on concept 9l, when dependent on concept 13, it is dependent on concept 13l, when dependent on concept 16, it is dependent on concept 16l, when dependent on concept 17, it is dependent on concept 17l, and when dependent on concept 18, it is dependent on concept 18l), wherein the $V_H$ domain comprises the CDRH2 sequence of SEQ ID NO:344 or 347, or the CDRH2 sequence of SEQ ID NO:344 or 347 comprising 3, 2 or 1 amino acid substitution(s).

Concept 20. The antibody or fragment according to any preceding concept, wherein the $V_H$ domain comprises an amino acid sequence of SEQ ID NO:33, or a heavy chain variable domain amino acid sequence that is at least 80% (e.g. at least 85%, or at least 90%) identical to SEQ ID NO:33.

Concept 20a: An antibody or a fragment thereof according to any preceding concept (but when dependent on concept 9, it is dependent on concept 9a, when dependent on concept 13, it is dependent on concept 13a, when dependent on concept 16, it is dependent on concept 16a, when dependent on concept 17, it is dependent on concept 17a, when dependent on concept 18, it is dependent on concept 18a, and when dependent on concept 19, it is dependent on concept 19a), wherein the $V_H$ domain comprises an amino acid sequence of SEQ ID NO:13, or a heavy chain variable domain amino acid sequence that is at least 80% (e.g. at least 85%, or at least 90%) identical to SEQ ID NO:13.

Concept 20b: An antibody or a fragment thereof according to any preceding concept (but when dependent on concept 9, it is dependent on concept 9b, when dependent on concept 13, it is dependent on concept 13b, when dependent on concept 16, it is dependent on concept 16b, when dependent on concept 17, it is dependent on concept 17b, when dependent on concept 18, it is dependent on concept 18b, and when dependent on concept 19, it is dependent on concept 19b), wherein the $V_H$ domain comprises an amino acid sequence of SEQ ID NO:58, or a heavy chain variable domain amino acid sequence that is at least 80% (e.g. at least 85%, or at least 90%) identical to SEQ ID NO:58.

Concept 20c: An antibody or a fragment thereof according to any preceding concept (but when dependent on concept 9, it is dependent on concept 9c, when dependent on concept 13, it is dependent on concept 13c, when dependent on concept 16, it is dependent on concept 16c, when dependent on concept 17, it is dependent on concept 17c, when dependent on concept 18, it is dependent on concept 18c, and when dependent on concept 19, it is dependent on concept 19c), wherein the $V_H$ domain comprises an amino acid sequence of SEQ ID NO:78, or a heavy chain variable domain amino acid sequence that is at least 80% (e.g. at least 85%, or at least 90%) identical to SEQ ID NO:78.

Concept 20d: An antibody or a fragment thereof according to any preceding concept (but when dependent on concept 9, it is dependent on concept 9d, when dependent on concept 13, it is dependent on concept 13d, when dependent on concept 16, it is dependent on concept 16d, when dependent on concept 17, it is dependent on concept 17d, when dependent on concept 18, it is dependent on concept 18d, and when dependent on concept 19, it is dependent on concept 19d), wherein the $V_H$ domain comprises an amino acid sequence of SEQ ID NO:98, or a heavy chain variable domain amino acid sequence that is at least 80% (e.g. at least 85%, or at least 90%) identical to SEQ ID NO:98.

Concept 20e: An antibody or a fragment thereof according to any preceding concept (but when dependent on concept 9, it is dependent on concept 9e, when dependent on concept 13, it is dependent on concept 13e, when dependent on concept 16, it is dependent on concept 16e, when dependent on concept 17, it is dependent on concept 17e, when dependent on concept 18, it is dependent on concept 18e, and when dependent on concept 19, it is dependent on concept 19e), wherein the $V_H$ domain comprises an amino acid sequence of SEQ ID NO:118, or a heavy chain variable domain amino acid sequence that is at least 80% (e.g. at least 85%, or at least 90%) identical to SEQ ID NO:118.

Concept 20f: An antibody or a fragment thereof according to any preceding concept (but when dependent on concept 9, it is dependent on concept 9f, when dependent on concept 13, it is dependent on concept 13f, when dependent on concept 16, it is dependent on concept 16f, when dependent on concept 17, it is dependent on concept 17f, when dependent on concept 18, it is dependent on concept 18f, and when dependent on concept 19, it is dependent on concept 19f), wherein the $V_H$ domain comprises an amino acid sequence of SEQ ID NO:158, or a heavy chain variable domain amino acid sequence that is at least 80% (e.g. at least 85%, or at least 90%) identical to SEQ ID NO:158.

Concept 20g: An antibody or a fragment thereof according to any preceding concept (but when dependent on concept 9, it is dependent on concept 9g, when dependent on concept 13, it is dependent on concept 13g, when dependent on concept 16, it is dependent on concept 16g, when dependent on concept 17, it is dependent on concept 17g, when dependent on concept 18, it is dependent on concept 18g, and when dependent on concept 19, it is dependent on concept 19g), wherein the $V_H$ domain comprises an amino acid sequence of SEQ ID NO:178, or a heavy chain variable domain amino acid sequence that is at least 80% (e.g. at least 85%, or at least 90%) identical to SEQ ID NO:178.

Concept 20h: An antibody or a fragment thereof according to any preceding concept (but when dependent on concept 9, it is dependent on concept 9h, when dependent on concept 13, it is dependent on concept 13h, when dependent on concept 16, it is dependent on concept 16h, when dependent on concept 17, it is dependent on concept 17h, when dependent on concept 18, it is dependent on concept 18h, and when dependent on concept 19, it is dependent on concept 19h), wherein the $V_H$ domain comprises an amino acid sequence of SEQ ID NO:138, or a heavy chain variable domain amino acid sequence that is at least 80% (e.g. at least 85%, or at least 90%) identical to SEQ ID NO:138.

Concept 20i: An antibody or a fragment thereof according to any preceding concept (but when dependent on concept 9, it is dependent on concept 9i, when dependent on concept 13, it is dependent on concept 13i, when dependent on concept 16, it is dependent on concept 16i, when dependent on concept 17, it is dependent on concept 17i, when dependent on concept 18, it is dependent on concept 18i, and when dependent on concept 19, it is dependent on concept 19i), wherein the $V_H$ domain comprises an amino acid sequence of SEQ ID NO:244, or a heavy chain variable domain amino acid sequence that is at least 80% (e.g. at least 85%, or at least 90%) identical to SEQ ID NO:244.

Concept 20j: An antibody or a fragment thereof according to any preceding concept (but when dependent on concept 9, it is dependent on concept 9j, when dependent on concept 13, it is dependent on concept 13j, when dependent on concept 16, it is dependent on concept 16j, when dependent on concept 17, it is dependent on concept 17j, when dependent on concept 18, it is dependent on concept 18j, and when dependent on concept 19, it is dependent on concept 19j), wherein the $V_H$ domain comprises an amino acid sequence of SEQ ID NO:264, or a heavy chain variable domain amino acid sequence that is at least 80% (e.g. at least 85%, or at least 90%) identical to SEQ ID NO:264.

Concept 20k: An antibody or a fragment thereof according to any preceding concept (but when dependent on concept 9, it is dependent on concept 9k, when dependent on concept 13, it is dependent on concept 13k, when dependent on concept 16, it is dependent on concept 16k, when dependent on concept 17, it is dependent on concept 17k, when dependent on concept 18, it is dependent on concept 18k, and when dependent on concept 19, it is dependent on concept 19k), wherein the $V_H$ domain comprises an amino acid sequence of SEQ ID NO:284, or a heavy chain variable domain amino acid sequence that is at least 80% (e.g. at least 85%, or at least 90%) identical to SEQ ID NO:284.

Concept 20l: An antibody or a fragment thereof according to any preceding concept (but when dependent on concept 9, it is dependent on concept 9l, when dependent on concept 13, it is dependent on concept 13l, when dependent on concept 16, it is dependent on concept 16l, when dependent on concept 17, it is dependent on concept 17l, when dependent on concept 18, it is dependent on concept 18l, and when dependent on concept 19, it is dependent on concept 19l), wherein the $V_H$ domain comprises an amino acid sequence of SEQ ID NO:349, or a heavy chain variable domain amino acid sequence that is at least 80% (e.g. at least 85%, or at least 90%) identical to SEQ ID NO:349.

In one embodiment, the amino acid sequence is at least 70% identical to the specified Seq ID No. In one embodiment, the amino acid sequence is at least 75% identical to the specified Seq ID No. In one embodiment, the amino acid sequence is at least 95% identical to the specified Seq ID No. In one embodiment, the amino acid sequence is at least 96% identical to the specified Seq ID No. In one embodiment, the amino acid sequence is at least 97% identical to the specified Seq ID No. In one embodiment, the amino acid sequence is at least 98% identical to the specified Seq ID No. In one embodiment, the amino acid sequence is at least 99% identical to the specified Seq ID No. In one embodiment, the amino acid sequence is at least 99.5% identical to the specified Seq ID No.

Concept 21. The antibody or fragment according to any preceding concept comprising first and second copies of said $V_H$ domain.

Concept 22. The antibody or fragment according to any preceding concept, comprising a $V_L$ domain which comprises the CDRL1 sequence of SEQ ID NO:37 or 40, or the CRDL1 sequence of SEQ ID NO:37 or 40 comprising 3 or fewer amino acid substitutions.

Concept 22a: An antibody or a fragment thereof according to any preceding concept (but when dependent on concept 9, it is dependent on concept 9a, when dependent on concept 13, it is dependent on concept 13a, when dependent on concept 16, it is dependent on concept 16a, when dependent on concept 17, it is dependent on concept 17a, when dependent on concept 18, it is dependent on concept 18a, when dependent on concept 19, it is dependent on concept 19a, and when dependent on concept 20, it is dependent on concept 20a), comprising a $V_L$ domain, which comprises the CDRL1 sequence of SEQ ID NO:17 or 20, or the CDRL1 sequence of SEQ ID NO:17 or 20 comprising 3 or fewer amino acid substitutions.

Concept 22b: An antibody or a fragment thereof according to any preceding concept (but when dependent on concept 9, it is dependent on concept 9b, when dependent on concept 13, it is dependent on concept 13b, when dependent on concept 16, it is dependent on concept 16b, when dependent on concept 17, it is dependent on concept 17b, when dependent on concept 18, it is dependent on concept 18b, when dependent on concept 19, it is dependent on concept 19b, and when dependent on concept 20, it is dependent on concept 20b), comprising a $V_L$ domain which comprises the CDRL1 sequence of SEQ ID NO:62 or 65, or the CDRL1 sequence of SEQ ID NO:62 or 65 comprising 3 or fewer amino acid substitutions.

Concept 22c: An antibody or a fragment thereof according to any preceding concept (but when dependent on concept 9, it is dependent on concept 9c, when dependent on concept 13, it is dependent on concept 13c, when dependent on concept 16, it is dependent on concept 16c, when dependent on concept 17, it is dependent on concept 17c, when dependent on concept 18, it is dependent on concept 18c, when dependent on concept 19, it is dependent on concept 19c, and when dependent on concept 20, it is dependent on concept 20c), comprising a $V_L$ domain which comprises the CDRL1 sequence of SEQ ID NO:82 or 85, or the CDRL1 sequence of SEQ ID NO:82 or 85 comprising 2 or 1 amino acid substitution(s).

Concept 22d: An antibody or a fragment thereof according to any preceding concept (but when dependent on concept 9, it is dependent on concept 9d, when dependent on concept 13, it is dependent on concept 13d, when dependent on concept 16, it is dependent on concept 16d, when dependent on concept 17, it is dependent on concept 17d, when dependent on concept 18, it is dependent on concept 18d, when dependent on concept 19, it is dependent on concept 19d, and when dependent on concept 20, it is dependent on concept 20d), comprising a $V_L$ domain which comprises the CDRL1 sequence of SEQ ID NO:102 or 105, or the CDRL1 sequence of SEQ ID NO:102 or 105 comprising 5 or fewer amino acid substitutions.

Concept 22e: An antibody or a fragment thereof according to any preceding concept (but when dependent on concept 9, it is dependent on concept 9e, when dependent on concept 13, it is dependent on concept 13e, when dependent on concept 16, it is dependent on concept 16e, when dependent on concept 17, it is dependent on concept 17e, when dependent on concept 18, it is dependent on concept 18e, when dependent on concept 19, it is dependent on concept 19e, and when dependent on concept 20, it is dependent on concept 20e), comprising a $V_L$ domain which comprises the CDRL1 sequence of SEQ ID NO:122 or 125, or the CDRL1 sequence of SEQ ID NO:122 or 125 comprising 2 or 1 amino acid substitution(s).

Concept 22f: An antibody or a fragment thereof according to any preceding concept (but when dependent on concept 9, it is dependent on concept 9f, when dependent on concept 13, it is dependent on concept 13f, when dependent on concept 16, it is dependent on concept 16f, when dependent on concept 17, it is dependent on concept 17f, when dependent on concept 18, it is dependent on concept 18f, when dependent on concept 19, it is dependent on concept 19f, and when dependent on concept 20, it is dependent on concept 20f), comprising a $V_L$ domain which comprises the CDRL1 sequence of SEQ ID NO:162 or 165, or the CDRL1 sequence of SEQ ID NO:162 or 165 comprising 5 or fewer amino acid substitutions.

Concept 22g: An antibody or a fragment thereof according to any preceding concept (but when dependent on concept 9, it is dependent on concept 9g, when dependent on concept 13, it is dependent on concept 13g, when dependent on concept 16, it is dependent on concept 16g, when dependent on concept 17, it is dependent on concept 17g, when dependent on concept 18, it is dependent on concept 18g, when dependent on concept 19, it is dependent on concept 19g, and when dependent on concept 20, it is dependent on concept 20g), comprising a $V_L$ domain which comprises the CDRL1 sequence of SEQ ID NO:182 or 185, or the CDRL1 sequence of SEQ ID NO:182 or 185 comprising 5 or fewer amino acid substitutions.

Concept 22h: An antibody or a fragment thereof according to any preceding concept (but when dependent on concept 9, it is dependent on concept 9h, when dependent on concept 13, it is dependent on concept 13h, when dependent on concept 16, it is dependent on concept 16h, when dependent on concept 17, it is dependent on concept 17h, when dependent on concept 18, it is dependent on concept 18h, when dependent on concept 19, it is dependent on concept 19h, and when dependent on concept 20, it is dependent on concept 20h), comprising a $V_L$ domain which comprises the CDRL1 sequence of SEQ ID NO:142 or 145, or the CDRL1 sequence of SEQ ID NO:142 or 145 comprising 2 or 1 amino acid substitution(s).

Concept 22i: An antibody or a fragment thereof according to any preceding concept (but when dependent on concept 9, it is dependent on concept 9i, when dependent on concept 13, it is dependent on concept 13i, when dependent on concept 16, it is dependent on concept 16i, when dependent on concept 17, it is dependent on concept 17i, when dependent on concept 18, it is dependent on concept 18i, when dependent on concept 19, it is dependent on concept 19i, and when dependent on concept 20, it is dependent on concept 20i), comprising a $V_L$ domain which comprises the CDRL1 sequence of SEQ ID NO:248 or 251, or the CDRL1 sequence of SEQ ID NO:248 or 251 comprising 2 or 1 amino acid substitution(s).

Concept 22j: An antibody or a fragment thereof according to any preceding concept (but when dependent on concept 9, it is dependent on concept 9j, when dependent on concept 13, it is dependent on concept 13j, when dependent on concept 16, it is dependent on concept 16j, when dependent on concept 17, it is dependent on concept 17j, when dependent on concept 18, it is dependent on concept 18j, when dependent on concept 19, it is dependent on concept 19j, and when dependent on concept 20, it is dependent on concept 20j), comprising a $V_L$ domain which comprises the CDRL1 sequence of SEQ ID NO:268 or 271, or the CDRL1 sequence of SEQ ID NO:268 or 271 comprising 2 or 1 amino acid substitution(s).

Concept 22k: An antibody or a fragment thereof according to any preceding concept (but when dependent on concept 9, it is dependent on concept 9k, when dependent on concept 13, it is dependent on concept 13k, when dependent on concept 16, it is dependent on concept 16k, when dependent on concept 17, it is dependent on concept 17k, when dependent on concept 18, it is dependent on concept 18k, when dependent on concept 19, it is dependent on concept 19k, and when dependent on concept 20, it is dependent on concept 20k), comprising a $V_L$ domain which comprises the CDRL1 sequence of SEQ ID NO:288 or 291, or the CDRL1 sequence of SEQ ID NO:288 or 291 comprising 2 or 1 amino acid substitution(s).

Concept 22l: An antibody or a fragment thereof according to any preceding concept (but when dependent on concept 9, it is dependent on concept 9l, when dependent on concept 13, it is dependent on concept 13l, when dependent on concept 16, it is dependent on concept 16l, when dependent on concept 17, it is dependent on concept 17l, when dependent on concept 18, it is dependent on concept 18l, when dependent on concept 19, it is dependent on concept 19l, and when dependent on concept 20, it is dependent on concept 20l), comprising a $V_L$ domain which comprises the CDRL1 sequence of SEQ ID NO:353 or 356, or the CDRL1 sequence of SEQ ID NO:353 or 356 comprising 2 or 1 amino acid substitution(s).

Concept 23. The antibody or fragment according to any preceding concept, comprising a or said $V_L$ domain, which $V_L$ domain comprises the CDRL2 sequence of SEQ ID NO:38 or 41, or the CRDL2 sequence of SEQ ID NO:38 or 41 comprising 2 or 1 amino acid substitution(s), for example a CDRL2 sequence of Seq ID No:50.

Concept 23a: An antibody or a fragment thereof according to any preceding concept (but when dependent on concept 9, it is dependent on concept 9a, when dependent on concept 13, it is dependent on concept 13a, when dependent on concept 16, it is dependent on concept 16a, when dependent on concept 17, it is dependent on concept 17a, when dependent on concept 18, it is dependent on concept 18a, when dependent on concept 19, it is dependent on concept 19a, when dependent on concept 20, it is dependent on concept 20a, and when dependent on concept 22, it is dependent on concept 22a), comprising a or said $V_L$ domain, which $V_L$ domain comprises the CDRL2 sequence of SEQ ID NO:18 or 21, or the CDRL2 sequence of SEQ ID NO:18 or 21 comprising 2 or 1 amino acid substitution(s).

Concept 23b: An antibody or a fragment thereof according to any preceding concept (but when dependent on concept 9, it is dependent on concept 9b, when dependent on concept 13, it is dependent on concept 13b, when dependent on concept 16, it is dependent on concept 16b, when dependent on concept 17, it is dependent on concept 17b, when dependent on concept 18, it is dependent on concept 18b, when dependent on concept 19, it is dependent on concept 19b, when dependent on concept 20, it is dependent on concept 20b, and when dependent on concept 22, it is dependent on concept 22b), comprising a or said $V_L$ domain, which $V_L$ domain comprises the CDRL2 sequence of SEQ ID NO:63 or 66, or the CDRL2 sequence of SEQ ID NO:63 or 66 comprising one amino acid substitution.

Concept 23c: An antibody or a fragment thereof according to any preceding concept (but when dependent on concept 9, it is dependent on concept 9c, when dependent on concept 13, it is dependent on concept 13c, when dependent on concept 16, it is dependent on concept 16c, when dependent on concept 17, it is dependent on concept 17c, when dependent on concept 18, it is dependent on concept 18c, when dependent on concept 19, it is dependent on concept 19c, when dependent on concept 20, it is dependent on concept 20c, and when dependent on concept 22, it is dependent on concept 22c), comprising a or said $V_L$ domain, which $V_L$ domain comprises the CDRL2 sequence of SEQ ID NO:83 or 86, or the CDRL2 sequence of SEQ ID NO:83 or 86 comprising one amino acid substitution.

Concept 23d: An antibody or a fragment thereof according to any preceding concept (but when dependent on concept 9, it is dependent on concept 9d, when dependent on concept 13, it is dependent on concept 13d, when dependent on concept 16, it is dependent on concept 16d, when dependent on concept 17, it is dependent on concept 17d, when dependent on concept 18, it is dependent on concept 18d, when dependent on concept 19, it is dependent on concept 19d, when dependent on concept 20, it is dependent on concept 20d, and when dependent on concept 22, it is dependent on concept 22d), comprising a or said $V_L$ domain, which $V_L$ domain comprises the CDRL2 sequence of SEQ ID NO:103 or 106, or the CDRL2 sequence of SEQ ID NO:103 or 106 comprising one amino acid substitution.

Concept 23e: An antibody or a fragment thereof according to any preceding concept (but when dependent on concept 9, it is dependent on concept 9e, when dependent on concept 13, it is dependent on concept 13e, when dependent on concept 16, it is dependent on concept 16e, when dependent on concept 17, it is dependent on concept 17e, when dependent on concept 18, it is dependent on concept 18e, when dependent on concept 19, it is dependent on concept 19e, when dependent on concept 20, it is dependent on concept 20e, and when dependent on concept 22, it is dependent on concept 22e), comprising a or said $V_L$ domain, which $V_L$ domain comprises the CDRL2 sequence of SEQ ID NO:123 or 126, or the CDRL2 sequence of SEQ ID NO:123 or 126 comprising one amino acid substitution.

Concept 23f: An antibody or a fragment thereof according to any preceding concept (but when dependent on concept 9, it is dependent on concept 9f, when dependent on concept 13, it is dependent on concept 13f, when dependent on concept 16, it is dependent on concept 16f, when dependent on concept 17, it is dependent on concept 17f, when dependent on concept 18, it is dependent on concept 18f, when dependent on concept 19, it is dependent on concept 19f, when dependent on concept 20, it is dependent on concept 20f, and when dependent on concept 22, it is dependent on concept 22f), comprising a or said $V_L$ domain, which $V_L$ domain comprises the CDRL2 sequence of SEQ ID NO:153 or 156, or the CDRL2 sequence of SEQ ID NO:153 or 156 comprising one amino acid substitution.

Concept 23g: An antibody or a fragment thereof according to any preceding concept (but when dependent on concept 9, it is dependent on concept 9g, when dependent on concept 13, it is dependent on concept 13g, when dependent on concept 16, it is dependent on concept 16g, when dependent on concept 17, it is dependent on concept 17g, when dependent on concept 18, it is dependent on concept 18g, when dependent on concept 19, it is dependent on concept 19g, when dependent on concept 20, it is dependent on concept 20g, and when dependent on concept 22, it is dependent on concept 22g), comprising a or said $V_L$ domain, which $V_L$ domain comprises the CDRL2 sequence of SEQ ID NO:183 or 186, or the CDRL2 sequence of SEQ ID NO:183 or 186 comprising one amino acid substitution.

Concept 23h: An antibody or a fragment thereof according to any preceding concept (but when dependent on concept 9, it is dependent on concept 9h, when dependent on concept 13, it is dependent on concept 13h, when dependent on concept 16, it is dependent on concept 16h, when dependent on concept 17, it is dependent on concept 17h, when dependent on concept 18, it is dependent on concept 18h, when dependent on concept 19, it is dependent on concept 19h, when dependent on concept 20, it is dependent on concept 20h, and when dependent on concept 22, it is dependent on concept 22h), comprising a or said $V_L$ domain, which $V_L$ domain comprises the CDRL2 sequence of SEQ ID NO:143 or 146, or the CDRL2 sequence of SEQ ID NO:143 or 146 comprising one amino acid substitution.

Concept 23i: An antibody or a fragment thereof according to any preceding concept (but when dependent on concept 9, it is dependent on concept 9i, when dependent on concept 13, it is dependent on concept 13i, when dependent on concept 16, it is dependent on concept 16i, when dependent on concept 17, it is dependent on concept 17i, when dependent on concept 18, it is dependent on concept 18i, when dependent on concept 19, it is dependent on concept 19i, when dependent on concept 20, it is dependent on concept 20i, and when dependent on concept 22, it is dependent on concept 22i), comprising a or said $V_L$ domain, which $V_L$ domain comprises the CDRL2 sequence of SEQ ID NO:249 or 252, or the CDRL2 sequence of SEQ ID NO:249 or 252 comprising one amino acid substitution.

Concept 23j: An antibody or a fragment thereof according to any preceding concept (but when dependent on concept 9, it is dependent on concept 9j, when dependent on concept 13, it is dependent on concept 13j, when dependent on concept 16, it is dependent on concept 16j, when dependent on concept 17, it is dependent on concept 17j, when dependent on concept 18, it is dependent on concept 18j, when dependent on concept 19, it is dependent on concept 19j, when dependent on concept 20, it is dependent on concept 20j, and when dependent on concept 22, it is dependent on concept 22j), comprising a or said $V_L$ domain, which $V_L$ domain comprises the CDRL2 sequence of SEQ ID NO:269 or 272, or the CDRL2 sequence of SEQ ID NO:269 or 272 comprising one amino acid substitution.

Concept 23k: An antibody or a fragment thereof according to any preceding concept (but when dependent on concept 9, it is dependent on concept 9k, when dependent on concept 13, it is dependent on concept 13k, when dependent on concept 16, it is dependent on concept 16k, when dependent on concept 17, it is dependent on concept 17k, when dependent on concept 18, it is dependent on concept 18k, when dependent on concept 19, it is dependent on concept 19k, when dependent on concept 20, it is dependent on concept 20k, and when dependent on concept 22, it is dependent on concept 22k), comprising a or said $V_L$ domain, which $V_L$ domain comprises the CDRL2 sequence of SEQ ID NO:289 or 292, or the CDRL2 sequence of SEQ ID NO:289 or 292 comprising one amino acid substitution.

Concept 23l: An antibody or a fragment thereof according to any preceding concept (but when dependent on concept 9, it is dependent on concept 9l, when dependent on concept 13, it is dependent on concept 13l, when dependent on concept 16, it is dependent on concept 16l, when dependent on concept 17, it is dependent on concept 17l, when dependent on concept 18, it is dependent on concept 18l, when dependent on concept 19, it is dependent on concept 19l, when dependent on concept 20, it is dependent on concept 20l, and when dependent on concept 22, it is dependent on concept 22l), comprising a or said $V_L$ domain, which $V_L$ domain comprises the CDRL2 sequence of SEQ ID NO:354 or 357, or the CDRL2 sequence of SEQ ID NO:354 or 357 comprising one amino acid substitution.

Concept 24. The antibody or fragment according to any preceding concept, comprising a or said $V_L$ domain, which $V_L$ domain comprises the CDRL3 sequence of SEQ ID NO:39 or 42, or the CRDL3 sequence of SEQ ID NO:39 or 42 comprising 4 or fewer amino acid substitutions.

Concept 24a: An antibody or a fragment thereof according to any preceding concept (but when dependent on concept 9, it is dependent on concept 9a, when dependent on concept 13, it is dependent on concept 13a, when dependent on concept 16, it is dependent on concept 16a, when dependent on concept 17, it is dependent on concept 17a, when dependent on concept 18, it is dependent on concept 18a, when dependent on concept 19, it is dependent on concept 19a, when dependent on concept 20, it is dependent on concept 20a, when dependent on concept 22, it is dependent on concept 22a, and when dependent on concept 23, it is dependent on concept 23a), comprising a or said $V_L$ domain, which $V_L$ domain comprises the CDRL3 sequence of SEQ ID NO:19 or 22, or the CDRL3 sequence of SEQ ID NO: 19 or 22 comprising 4 or fewer amino acid substitutions.

Concept 24b: An antibody or a fragment thereof according to any preceding concept (but when dependent on concept 9, it is dependent on concept 9b, when dependent on concept 13, it is dependent on concept 13b, when dependent on concept 16, it is dependent on concept 16b, when dependent on concept 17, it is dependent on concept 17b, when dependent on concept 18, it is dependent on concept 18b, when dependent on concept 19, it is dependent on concept 19b, when dependent on concept 20, it is dependent on concept 20b, when dependent on concept 22, it is dependent on concept 22b, and when dependent on concept 23, it is dependent on concept 23b), comprising a or said $V_L$ domain, which $V_L$ domain comprises the CDRL3 sequence of SEQ ID NO:64 or 67, or the CDRL3 sequence of SEQ ID NO:64 or 67 comprising 4 or fewer amino acid substitutions.

Concept 24c: An antibody or a fragment thereof according to any preceding concept (but when dependent on concept 9, it is dependent on concept 9c, when dependent on concept 13, it is dependent on concept 13c, when dependent on concept 16, it is dependent on concept 16c, when dependent on concept 17, it is dependent on concept 17c, when dependent on concept 18, it is dependent on concept 18c, when dependent on concept 19, it is dependent on concept 19c, when dependent on concept 20, it is dependent on concept 20c, when dependent on concept 22, it is dependent on concept 22c, and when dependent on concept 23, it is dependent on concept 23c), comprising a or said $V_L$ domain, which $V_L$ domain comprises the CDRL3 sequence of SEQ ID NO:84 or 87, or the CDRL3 sequence of SEQ ID NO:84 or 87 comprising 4 or fewer amino acid substitutions.

Concept 24d: An antibody or a fragment thereof according to any preceding concept (but when dependent on concept 9, it is dependent on concept 9d, when dependent on concept 13, it is dependent on concept 13d, when dependent on concept 16, it is dependent on concept 16d, when dependent on concept 17, it is dependent on concept 17d, when dependent on concept 18, it is dependent on concept 18d, when dependent on concept 19, it is dependent on concept 19d, when dependent on concept 20, it is dependent on concept 20d, when dependent on concept 22, it is dependent on concept 22d, and when dependent on concept 23, it is dependent on concept 23d), comprising a or said $V_L$ domain, which $V_L$ domain comprises the CDRL3 sequence of SEQ ID NO:104 or 107, or the CDRL3 sequence of SEQ ID NO:104 or 107 comprising 4 or fewer amino acid substitutions.

Concept 24e: An antibody or a fragment thereof according to any preceding concept (but when dependent on concept 9, it is dependent on concept 9e, when dependent on concept 13, it is dependent on concept 13e, when dependent on concept 16, it is dependent on concept 16e, when dependent on concept 17, it is dependent on concept 17e, when dependent on concept 18, it is dependent on concept 18e, when dependent on concept 19, it is dependent on concept 19e, when dependent on concept 20, it is dependent on concept 20e, when dependent on concept 22, it is dependent on concept 22e, and when dependent on concept 23, it is dependent on concept 23e), comprising a or said $V_L$ domain, which $V_L$ domain comprises the CDRL3 sequence of SEQ ID NO:124 or 127, or the CDRL3 sequence of SEQ ID NO:124 or 127 comprising 4 or fewer amino acid substitutions.

Concept 24f: An antibody or a fragment thereof according to any preceding concept (but when dependent on concept 9, it is dependent on concept 9f, when dependent on concept 13, it is dependent on concept 13f, when dependent on concept 16, it is dependent on concept 16f, when dependent on concept 17, it is dependent on concept 17f, when dependent on concept 18, it is dependent on concept 18f, when dependent on concept 19, it is dependent on concept 19f, when dependent on concept 20, it is dependent on concept 20f, when dependent on concept 22, it is dependent on concept 22f, and when dependent on concept 23, it is dependent on concept 23f), comprising a or said $V_L$ domain, which $V_L$ domain comprises the CDRL3 sequence of SEQ ID NO:164 or 167, or the CDRL3 sequence of SEQ ID NO:164 or 167 comprising 4 or fewer amino acid substitutions.

Concept 24g: An antibody or a fragment thereof according to any preceding concept (but when dependent on concept 9, it is dependent on concept 9g, when dependent on concept 13, it is dependent on concept 13g, when dependent on concept 16, it is dependent on concept 16g, when dependent on concept 17, it is dependent on concept 17g, when dependent on concept 18, it is dependent on concept 18g, when dependent on concept 19, it is dependent on concept 19g, when dependent on concept 20, it is dependent on concept 20g, when dependent on concept 22, it is dependent on concept 22g, and when dependent on concept 23, it is dependent on concept 23g), comprising a or said $V_L$ domain, which $V_L$ domain comprises the CDRL3 sequence of SEQ ID NO:184 or 187, or the CDRL3 sequence of SEQ ID NO:184 or 187 comprising 4 or fewer amino acid substitutions.

Concept 24h: An antibody or a fragment thereof according to any preceding concept (but when dependent on concept 9, it is dependent on concept 9h, when dependent on concept 13, it is dependent on concept 13h, when dependent on concept 16, it is dependent on concept 16h, when dependent on concept 17, it is dependent on concept 17h, when dependent on concept 18, it is dependent on concept 18h, when dependent on concept 19, it is dependent on concept 19h, when dependent on concept 20, it is dependent on concept 20h, when dependent on concept 22, it is dependent on concept 22h, and when dependent on concept 23, it is dependent on concept 23h), comprising a or said $V_L$ domain, which $V_L$ domain comprises the CDRL3 sequence of SEQ ID NO:144 or 147, or the CDRL3 sequence of SEQ ID NO:144 or 147 comprising 4 or fewer amino acid substitutions.

Concept 24i: An antibody or a fragment thereof according to any preceding concept (but when dependent on concept 9, it is dependent on concept 9i, when dependent on concept 13, it is dependent on concept 13i, when dependent on concept 16, it is dependent on concept 16i, when dependent on concept 17, it is dependent on concept 17i, when dependent on concept 18, it is dependent on concept 18i, when dependent on concept 19, it is dependent on concept 19i, when dependent on concept 20, it is dependent on concept 20i, when dependent on concept 22, it is dependent on concept 22i, and when dependent on concept 23, it is dependent on concept 23i), comprising a or said $V_L$ domain, which $V_L$ domain comprises the CDRL3 sequence of SEQ ID NO:250 or 253, or the CDRL3 sequence of SEQ ID NO:250 or 253 comprising 4 or fewer amino acid substitutions.

Concept 24j: An antibody or a fragment thereof according to any preceding concept (but when dependent on concept 9, it is dependent on concept 9j, when dependent on concept 13, it is dependent on concept 13j, when dependent on concept 16, it is dependent on concept 16j, when dependent on concept 17, it is dependent on concept 17j, when dependent on concept 18, it is dependent on concept 18j, when dependent on concept 19, it is dependent on concept 19j, when dependent on concept 20, it is dependent on concept 20j, when dependent on concept 22, it is dependent on concept 22j, and when dependent on concept 23, it is dependent on concept 23j), comprising a or said $V_L$ domain, which $V_L$ domain comprises the CDRL3 sequence of SEQ ID NO:270 or 273, or the CDRL3 sequence of SEQ ID NO:270 or 273 comprising 4 or fewer amino acid substitutions.

Concept 24k: An antibody or a fragment thereof according to any preceding concept (but when dependent on concept 9, it is dependent on concept 9k, when dependent on concept 13, it is dependent on concept 13k, when dependent on concept 16, it is dependent on concept 16k, when dependent on concept 17, it is dependent on concept 17k, when dependent on concept 18, it is dependent on concept 18k, when dependent on concept 19, it is dependent on concept 19k, when dependent on concept 20, it is dependent on concept 20k, when dependent on concept 22, it is dependent on concept 22k, and when dependent on concept 23, it is dependent on concept 23k), comprising a or said $V_L$ domain, which $V_L$ domain comprises the CDRL3 sequence of SEQ ID NO:290 or 293, or the CDRL3 sequence of SEQ ID NO:290 or 293 comprising 4 or fewer amino acid substitutions.

Concept 24l: An antibody or a fragment thereof according to any preceding concept (but when dependent on concept 9, it is dependent on concept 9l, when dependent on concept 13, it is dependent on concept 13l, when dependent on concept 16, it is dependent on concept 16l, when dependent on concept 17, it is dependent on concept 17l, when dependent on concept 18, it is dependent on concept 18l, when dependent on concept 19, it is dependent on concept 19l, when dependent on concept 20, it is dependent on concept 20l, when dependent on concept 22, it is dependent on concept 22l, and when dependent on concept 23, it is dependent on concept 23l), comprising a or said $V_L$ domain, which $V_L$ domain comprises the CDRL3 sequence of SEQ ID NO:355 or 358, or the CDRL3 sequence of SEQ ID NO:355 or 358 comprising 4 or fewer amino acid substitutions.

Concept 25. The antibody or fragment according to any preceding concept, comprising a or said $V_L$ domain, which $V_L$ domain comprises an amino acid sequence of SEQ ID NO:43, or a light chain variable domain amino acid sequence that is at least 80% (e.g. at least 85%, or at least 90%) identical to SEQ ID NO:43 (for example the $V_L$ domain sequence in the light chain sequence of Seq ID No:50, 51 or 298).

Concept 25a: An antibody or a fragment thereof according to any preceding concept (but when dependent on concept 9, it is dependent on concept 9a, when dependent on concept 13, it is dependent on concept 13a, when dependent on concept 16, it is dependent on concept 16a, when dependent on concept 17, it is dependent on concept 17a, when dependent on concept 18, it is dependent on concept 18a, when dependent on concept 19, it is dependent on concept 19a, when dependent on concept 20, it is dependent on concept 20a, when dependent on concept 22, it is dependent on concept 22a, when dependent on concept 23, it is dependent on concept 23a, and when dependent on concept 24, it is dependent on concept 24a), wherein the $V_L$ domain comprises an amino acid sequence of SEQ ID NO:23, or a light chain variable domain amino acid sequence that is at least 80% (e.g. at least 85%, or at least 90%) identical to SEQ ID NO:23.

Concept 25b: An antibody or a fragment thereof according to any preceding concept (but when dependent on concept 9, it is dependent on concept 9b, when dependent on concept 13, it is dependent on concept 13b, when dependent on concept 16, it is dependent on concept 16b, when dependent on concept 17, it is dependent on concept 17b, when dependent on concept 18, it is dependent on concept 18b, when dependent on concept 19, it is dependent on concept 19b, when dependent on concept 20, it is dependent on concept 20b, when dependent on concept 22, it is dependent on concept 22a, when dependent on concept 23, it is dependent on concept 23b, and when dependent on concept 24, it is dependent on concept 24b), wherein the $V_L$ domain comprises an amino acid sequence of SEQ ID NO:68, or a light chain variable domain amino acid sequence that is at least 80% (e.g. at least 85%, or at least 90%) identical to SEQ ID NO:68.

Concept 25c: An antibody or a fragment thereof according to any preceding concept (but when dependent on concept 9, it is dependent on concept 9c, when dependent on concept 13, it is dependent on concept 13c, when dependent on concept 16, it is dependent on concept 16c, when dependent on concept 17, it is dependent on concept 17c, when dependent on concept 18, it is dependent on concept 18c, when dependent on concept 19, it is dependent on concept 19c, when dependent on concept 20, it is dependent on concept 20c, when dependent on concept 22, it is dependent on concept 22c, when dependent on concept 23, it is dependent on concept 23c, and when dependent on concept 24, it is dependent on concept 24c), wherein the $V_L$ domain comprises an amino acid sequence of SEQ ID NO:88, or a light chain variable domain amino acid sequence that is at least 80% (e.g. at least 85%, or at least 90%) identical to SEQ ID NO:88.

Concept 25d: An antibody or a fragment thereof according to any preceding concept (but when dependent on concept 9, it is dependent on concept 9d, when dependent on concept 13, it is dependent on concept 13d, when dependent on concept 16, it is dependent on concept 16d, when dependent on concept 17, it is dependent on concept 17d, when dependent on concept 18, it is dependent on concept 18d, when dependent on concept 19, it is dependent on concept 19d, when dependent on concept 20, it is dependent on concept 20d, when dependent on concept 22, it is dependent on concept 22d, when dependent on concept 23, it is dependent on concept 23d, and when dependent on concept 24, it is dependent on concept 24d), wherein the $V_L$ domain comprises an amino acid sequence of SEQ ID NO:108, or a light chain variable domain amino acid sequence that is at least 80% (e.g. at least 85%, or at least 90%) identical to SEQ ID NO:108.

Concept 25e: An antibody or a fragment thereof according to any preceding concept (but when dependent on concept 9, it is dependent on concept 9e, when dependent on concept 13, it is dependent on concept 13e, when dependent on concept 16, it is dependent on concept 16e, when dependent on concept 17, it is dependent on concept 17e, when dependent on concept 18, it is dependent on concept 18e, when dependent on concept 19, it is dependent on concept 19e, when dependent on concept 20, it is dependent on concept 20e, when dependent on concept 22, it is dependent on concept 22e, when dependent on concept 23, it is dependent on concept 23e, and when dependent on concept 24, it is dependent on concept 24e), wherein the $V_L$ domain comprises an amino acid sequence of SEQ ID NO:128, or a light chain variable domain amino acid sequence that is at least 80% (e.g. at least 85%, or at least 90%) identical to SEQ ID NO:128.

Concept 25f: An antibody or a fragment thereof according to any preceding concept (but when dependent on concept 9, it is dependent on concept 9f, when dependent on concept 13, it is dependent on concept 13f, when dependent on concept 16, it is dependent on concept 16f, when dependent on concept 17, it is dependent on concept 17f, when dependent on concept 18, it is dependent on concept 18f, when dependent on concept 19, it is dependent on concept 19f, when dependent on concept 20, it is dependent on concept 20f, when dependent on concept 22, it is dependent on concept 22f, when dependent on concept 23, it is dependent on concept 23f, and when dependent on concept 24, it is dependent on concept 24f), wherein the $V_L$ domain comprises an amino acid sequence of SEQ ID NO:168, or a light chain variable domain amino acid sequence that is at least 80% (e.g. at least 85%, or at least 90%) identical to SEQ ID NO:168.

Concept 25g: An antibody or a fragment thereof according to any preceding concept (but when dependent on concept 9, it is dependent on concept 9g, when dependent on concept 13, it is dependent on concept 13g, when dependent on concept 16, it is dependent on concept 16g, when dependent on concept 17, it is dependent on concept 17g, when dependent on concept 18, it is dependent on concept 18g, when dependent on concept 19, it is dependent on concept 19g, when dependent on concept 20, it is dependent on concept 20g, when dependent on concept 22, it is dependent on concept 22g, when dependent on concept 23, it is dependent on concept 23g, and when dependent on concept 24, it is dependent on concept 24g), wherein the $V_L$ domain comprises an amino acid sequence of SEQ ID NO:188, or a light chain variable domain amino acid sequence that is at least 80% (e.g. at least 85%, or at least 90%) identical to SEQ ID NO:188.

Concept 25h: An antibody or a fragment thereof according to any preceding concept (but when dependent on concept 9, it is dependent on concept 9h, when dependent on concept 13, it is dependent on concept 13h, when dependent on concept 16, it is dependent on concept 16h, when dependent on concept 17, it is dependent on concept 17h, when dependent on concept 18, it is dependent on concept 18h, when dependent on concept 19, it is dependent on concept 19h, when dependent on concept 20, it is dependent on concept 20h, when dependent on concept 22, it is dependent on concept 22h, when dependent on concept 23, it is dependent on concept 23h, and when dependent on concept 24, it is dependent on concept 24h), wherein the $V_L$ domain comprises an amino acid sequence of SEQ ID NO:148, or a light chain variable domain amino acid sequence that is at least 80% (e.g. at least 85%, or at least 90%) identical to SEQ ID NO:148.

Concept 25i: An antibody or a fragment thereof according to any preceding concept (but when dependent on concept 9, it is dependent on concept 9i, when dependent on concept 13, it is dependent on concept 13i, when dependent on concept 16, it is dependent on concept 16i, when dependent on concept 17, it is dependent on concept 17i, when dependent on concept 18, it is dependent on concept 18i, when dependent on concept 19, it is dependent on concept 19i, when dependent on concept 20, it is dependent on concept 20i, when dependent on concept 22, it is dependent on concept 22i, when dependent on concept 23, it is dependent on concept 23i, and when dependent on concept 24, it is dependent on concept 24i), wherein the $V_L$ domain comprises an amino acid sequence of SEQ ID NO:254, or a light chain variable domain amino acid sequence that is at least 80% (e.g. at least 85%, or at least 90%) identical to SEQ ID NO:254.

Concept 25j: An antibody or a fragment thereof according to any preceding concept (but when dependent on concept 9, it is dependent on concept 9j, when dependent on concept 13, it is dependent on concept 13j, when dependent on concept 16, it is dependent on concept 16j, when dependent on concept 17, it is dependent on concept 17j, when dependent on concept 18, it is dependent on concept 18j, when dependent on concept 19, it is dependent on concept 19j, when dependent on concept 20, it is dependent on concept 20j, when dependent on concept 22, it is dependent on concept 22j, when dependent on concept 23, it is dependent on concept 23j, and when dependent on concept 24, it is dependent on concept 24j), wherein the $V_L$ domain comprises an amino acid sequence of SEQ ID NO:274, or a light chain variable domain amino acid sequence that is at least 80% (e.g. at least 85%, or at least 90%) identical to SEQ ID NO:274.

Concept 25k: An antibody or a fragment thereof according to any preceding concept (but when dependent on concept 9, it is dependent on concept 9k, when dependent on concept 13, it is dependent on concept 13k, when dependent on concept 16, it is dependent on concept 16k, when dependent on concept 17, it is dependent on concept 17k, when dependent on concept 18, it is dependent on concept 18k, when dependent on concept 19, it is dependent on concept 19k, when dependent on concept 20, it is dependent on concept 20k, when dependent on concept 22, it is dependent on concept 22k, when dependent on concept 23, it is dependent on concept 23k, and when dependent on concept 24, it is dependent on concept 24k), wherein the $V_L$ domain comprises an amino acid sequence of SEQ ID NO:294, or a light chain variable domain amino acid sequence that is at least 80% (e.g. at least 85%, or at least 90%) identical to SEQ ID NO:294.

Concept 25l: An antibody or a fragment thereof according to any preceding concept (but when dependent on concept 9, it is dependent on concept 9l, when dependent on concept 13, it is dependent on concept 13l, when dependent on concept 16, it is dependent on concept 16l, when dependent on concept 17, it is dependent on concept 17l, when dependent on concept 18, it is dependent on concept 18l, when dependent on concept 19, it is dependent on concept 19l, when dependent on concept 20, it is dependent on concept 20l, when dependent on concept 22, it is dependent on concept 22l, when dependent on concept 23, it is dependent on concept 23l, and when dependent on concept 24, it is dependent on concept 24l), wherein the $V_L$ domain comprises an amino acid sequence of SEQ ID NO:359, or a light chain variable domain amino acid sequence that is at least 80% (e.g. at least 85%, or at least 90%) identical to SEQ ID NO:359.

In one embodiment, the amino acid sequence is at least 70% identical to the specified Seq ID No. In one embodiment, the amino acid sequence is at least 75% identical to the specified Seq ID No. In one embodiment, the amino acid sequence is at least 95% identical to the specified Seq ID No. In one embodiment, the amino acid sequence is at least 96% identical to the specified Seq ID No. In one embodiment, the amino acid sequence is at least 97% identical to the specified Seq ID No. In one embodiment, the amino acid sequence is at least 98% identical to the specified Seq ID No. In one embodiment, the amino acid sequence is at least 99% identical to the specified Seq ID No. In one embodiment, the amino acid sequence is at least 99.5% identical to the specified Seq ID No.

Concept 26. The antibody or fragment according to any one of concepts 12 to 21, comprising first and second copies of a or said $V_L$ domain.

Concept 27. The antibody or fragment according to any preceding concept which specifically binds to cynomolgus PD-L1 as defined by Seq ID No:2.

In one embodiment, the antibody or fragment binds to cynomolgus PD-L1 with an affinity of less than 1 nM (e.g. from 1 nM to 0.01 pM or from 1 nM to 0.1 pM, or from 1 nM to 1 pM). In one embodiment, the antibody or fragment binds to cynomolgus PD-L1 with an affinity of less than 10 nM (e.g. from 10 nM to 0.01 pM or from 10 nM to 0.1 pM, or from 10 nM to 1 pM). In one embodiment, the antibody or fragment binds to cynomolgus PD-L1 with an affinity of less than 0.1 nM (e.g. from 0.1 nM to 0.01 pM or from 0.1 nM to 0.1 pM, or from 0.1 nM to 1 pM). In one embodiment, the antibody or fragment binds to cynomolgus PD-L1 with an affinity of less than 0.01 nM (e.g. from 0.011 nM to 0.01 pM or from 0.01 nM to 0.1 pM).

In one embodiment, the antibody or fragment binds to cynomolgus PD-L1 with an affinity of within 2-fold of the affinity to hPD-L1. In one embodiment, the antibody or fragment binds to cynomolgus PD-L1 with an affinity of within 4-fold of the affinity to hPD-L1. In one embodiment, the antibody or fragment binds to cynomolgus PD-L1 with an affinity of within 5-fold of the affinity to hPD-L1. In one embodiment, the antibody or fragment binds to cynomolgus PD-L1 with an affinity of within 6-fold of the affinity to hPD-L1. In one embodiment, the antibody or fragment binds to cynomolgus PD-L1 with an affinity of within 8-fold of the affinity to hPD-L1. In one embodiment, the antibody or fragment binds to cynomolgus PD-L1 with an affinity of within 10-fold of the affinity to hPD-L1.

In one embodiment, the antibody or fragment does not detectably bind to cynomolgus PD-L1. In one embodiment, the antibody or fragment does not detectably bind to murine PD-1.

In one embodiment, the antibody or fragment binds to murine PD-L1 with an affinity of less than 1 nM (e.g. from 1 nM to 0.01 pM or from 1 nM to 0.1 pM, or from 1 nM to 1 pM). In one embodiment, the antibody or fragment binds to murine PD-L1 with an affinity of less than 10 nM (e.g. from 10 nM to 0.01 pM or from 10 nM to 0.1 pM, or from 10 nM to 1 pM). In one embodiment, the antibody or fragment binds to murine PD-L1 with an affinity of less than 0.1 nM (e.g. from 0.1 nM to 0.01 pM or from 0.1 nM to 0.1 pM, or from 0.1 nM to 1 pM). In one embodiment, the antibody or fragment binds to murine PD-L1 with an affinity of less than 0.01 nM (e.g. from 0.011 nM to 0.01 pM or from 0.01 nM to 0.1 pM).

Concept 28. The antibody or fragment according to any preceding concept, wherein the antibody or fragment comprises a kappa light chain.

Kappa light chain constant region amino acid and nucleotide sequences can be found in Seq ID Nos:206 to 215.

In one embodiment, the light chain may be a lambda light chain. Lambda light chain constant region amino acid and nucleotide sequences can be found in Seq ID Nos:216 to 237 and Seq ID No:535, Seq ID No:536 and Seq ID No:538.

Concept 29. The antibody or fragment according to any one of concepts 9 to 28, wherein the amino acid substitutions are conservative amino acid substitutions, optionally wherein the conservative substitutions are from one of six groups (each group containing amino acids that are conservative substitutions for one another) selected from:
1) Alanine (A), Serine (S), Threonine (T);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V); and
6) Phenylalanine (F), Tyrosine (Y), Tryptophan (W).

Conservative substitutions may be as described above in concept 9.

Concept 30. The antibody or fragment according to any preceding concept, wherein the antibody or fragment comprises a constant region, such as a human constant region, for example an effector-null human constant region, e.g. an IgG4 constant region or an IgG1 constant region, optionally wherein the constant region is IgG4-PE (Seq ID No:199), or a disabled IgG1 as defined in Seq ID No:205.

In other embodiments, the antibody or fragment is any of the isotypes or constant regions as defined hereinabove. In one embodiment, the constant region is wild-type human IgG1 (Seq ID No:340). For example, the constant region is an effector-enabled IgG1 constant region, optionally having ADCC and/or CDC activity. In one embodiment, the constant region is engineered for enhanced ADCC and/or CDC and/or ADCP. In another embodiment, the constant region is engineered for enhanced effector function.

The IgG4 constant region may be any of the IgG4 constant region amino acid sequences, or encoded by any of the nucleic acid sequences of Seq ID Nos:192 to 203. A heavy chain constant region may be an IgG4 comprising both the Leu235Glu mutation and the Ser228Pro mutation. This "IgG4-PE" heavy chain constant region (Seq ID Nos: 199, encoded by Seq ID Nos:198, 200 and 201) is effector null.

An alternative effector null human constant region is a disabled IgG1 being an IgG1*01 allele comprising the L235A and/or G237A mutations (e.g. LAGA, Seq ID No:205, encoded by Seq ID No:204). In one embodiment, the antibodies or antibody fragments disclosed herein comprise an IgG1 heavy chain constant region, wherein the sequence contains alanine at position 235 and/or 237 (EU index numbering).

The antibody-dependent cell phagocytosis (ADCP) mechanism is discussed in Gul et at, "Antibody-Dependent Phagocytosis of Tumor Cells by Macrophages: A Potent Effector Mechanism of Monoclonal Antibody Therapy of Cancer", Cancer Res., 75(23), Dec. 1, 2015.

The potency of Fc-mediated effects may be enhanced by engineering the Fc domain by various established techniques. Such methods increase the affinity for certain Fc-receptors, thus creating potential diverse profiles of activation enhancement. This can be achieved by modification of one or several amino acid residues (e.g. as described in Lazar et al., 2006, Proc. Natl. Acad. Sci. U.S.A., March 14; 103(11):4005-10; the modifications disclosed therein are incorporated herein by reference). Human IgG1 constant regions containing specific mutations or altered glycosylation on residue Asn297 (e.g. N297Q, EU index numbering) have been shown to enhance binding to Fc receptors. In one embodiment, such mutations are one or more of the residues selected from 239, 332 and 330 for human IgG1 constant regions (or the equivalent positions in other IgG isotypes). In one embodiment, the antibody or fragment comprises a human IgG1 constant region having one or more mutations independently selected from N297Q, S239D, I332E and A330L (EU index numbering).

In another embodiment, the increase in affinity for Fc-receptors is achieved by altering the natural glycosylation profile of the Fc domain by, for example, generating under fucosylated or de-fucosylated variants (as described in Natsume et al., 2009, Drug Des. Devel. Ther., 3:7-16 or by Zhou Q., Biotechnol. Bioeng., 2008, Feb. 15, 99(3):652-65, the modifications described therein are incorporated herein by reference). Non-fucosylated antibodies harbour a tri-mannosyl core structure of complex-type N-glycans of Fc without fucose residue. These glycoengineered antibodies that lack core fucose residue from the Fc N-glycans may exhibit stronger ADCC than fucosylated equivalents due to enhancement of FcγRIIIa binding capacity. For example, to increase ADCC, residues in the hinge region can be altered to increase binding to Fc-γRIII (see, for example, Shields et al., 2001, J. Biol. Chem., March 2; 276(9):6591-604; the modifications described therein are incorporated herein by reference). Thus, in one embodiment, the antibody or fragment comprises a human IgG heavy chain constant region that is a variant of a wild-type human IgG heavy chain constant region, wherein the variant human IgG heavy chain constant region binds to human Fcγ receptors selected from the group consisting of FcγRIIB and FcγRIIA with higher affinity than the wild type human IgG heavy chain constant region binds to the human Fcγ receptors. In one embodiment, the antibody or fragment comprises a human IgG heavy chain constant region that is a variant of a wild type human IgG heavy chain constant region, wherein the variant human IgG heavy chain constant region binds to human FcγRIIB with higher affinity than the wild type human IgG heavy chain constant region binds to human FcγRIIB. In one embodiment, the variant human IgG heavy chain constant region is a variant human IgG1, a variant human IgG2, or a variant human IgG4 heavy chain constant region. In one embodiment, the variant human IgG heavy chain constant region comprises one or more amino acid mutations selected from G236D, P238D, S239D, 5267E, L328F, and L328E (EU index numbering system). In another embodiment, the variant human IgG heavy chain constant region comprises a set of amino acid mutations selected from the group consisting of: S267E and L328F; P238D and L328E; P238D and one or more substitutions selected from the group consisting of E233D, G237D, H268D, P271G, and A330R; P238D, E233D, G237D, H268D, P271G, and A330R; G236D and S267E; S239D and S267E; V262E, S267E, and L328F; and V264E, S267E, and L328F (EU index numbering system). In another embodiment, the variant human IgG heavy chain constant region further comprises one or more amino acid mutations that reduce the affinity of the IgG for human FcγRIIIA, human FcγRIIA, or human FcγRI. In one embodiments, the FcγRIIB is expressed on a cell selected from the group consisting of macrophages, monocytes, B-cells, dendritic cells, endothelial cells, and activated T-cells. In one embodiment, the variant human IgG heavy chain constant region comprises one or more of the following amino acid mutations G236A, S239D, F243L, T256A, K290A, R292P, S298A, Y300L, V305I, A330L, I332E, E333A, K334A, A339T, and P396L (EU index numbering system). In one embodiment, the variant human IgG heavy chain constant region comprises a set of amino acid mutations selected from the group consisting of: S239D; T256A; K290A; S298A; I332E; E333A; K334A; A339T; S239D and I332E; S239D, A330L, and I332E; S298A, E333A, and K334A; G236A, S239D, and I332E; and F243L, R292P, Y300L, V305I, and P396L (EU index numbering system). In one embodiment, the variant human IgG heavy chain constant region comprises a S239D, A330L, or I332E amino acid mutations (EU index numbering system). In one embodiment, the variant human IgG heavy chain constant region comprises an S239D and I332E amino acid mutations (EU index numbering system). In one embodiment, the variant human IgG heavy chain constant region is a variant human IgG1 heavy chain constant region comprising the S239D and I332E amino acid mutations (EU index numbering system). In one embodiment, the antibody or fragment comprises an afucosylated Fc region. In another embodiment, the antibody or fragment thereof is defucosylated. In another embodiment, the antibody or fragment is under fucosylated.

In another embodiment, the antibodies and fragments disclosed herein may comprise a triple mutation (M252Y/S254T/T256E) which enhances binding to FcRn. See Dall et al., Immunol 2002; 169:5171-5180 for a discussion of mutations affection FcRn binding in table 2, the mutations described therein are incorporated herein by reference.

Equally, the enhancement of CDC may be achieved by amino acid changes that increase affinity for C1q, the first component of the classic complement activation cascade (see Idusogie et al., J. Immunol., 2001, 166:2571-2575; the modifications described are incorporated herein by reference). Another approach is to create a chimeric Fc domain created from human IgG1 and human IgG3 segments that exploit the higher affinity if IgG3 for C1q (Natsume et al., 2008, Cancer Res., 68: 3863-3872; the modifications are incorporated herein by reference). In another embodiment, the antibody or antibody fragments disclosed herein may comprise mutated amino acids at residues 329, 331 and/or 322 to alter the C1q binding and/or reduced or abolished CDC activity. In another embodiment, the antibodies or antibody fragments disclosed herein may contain Fc regions with modifications at residues 231 and 239, whereby the amino acids are replaced to alter the ability of the antibody to fix complement. In one embodiment, the antibody or fragment has a constant region comprising one or more mutations selected from E345K, E430G, R344D and D356R, in particular a double mutation comprising R344D and D356R (EU index numbering system).

An antibody may have a heavy chain constant region that binds one or more types of Fc receptor but does not induce cellular effector functions, i.e. which does not mediate ADCC, CDC or ADCP activity. Such a constant region may be unable to bind the particular Fc receptor(s) responsible for triggering ADCC, CDC or ADCP activity. An antibody may have a heavy chain constant region that does not bind Fcγ receptors. Thus, in one embodiment, the constant region may comprise a Leu235Glu mutation (EU index numbering system).

In another embodiment, the antibodies and fragments disclosed herein are modified to increase or decrease serum half-life. In one embodiment, one or more of the following mutations: T252L, T254S or T256F are introduced to increase biological half-life of the antibody. Biological half-life can also be increased by altering the heavy chain constant region $CH_1$ domain or $C_L$ region to contain a salvage receptor binding epitope taken from two loops of a $CH_2$ domain of an Fc region of an IgG, as described in U.S. Pat. Nos. 5,869,046 and 6,121,022, the modifications described therein are incorporated herein by reference. In another embodiment, the Fc hinge region of an antibody or antigen-binding fragment of the invention is mutated to decrease the biological half-life of the antibody or fragment. One or more amino acid mutations are introduced into the $CH_2$—$CH_3$ domain interface region of the Fc-hinge fragment such that the antibody or fragment has impaired Staphylococcyl protein A (SpA) binding relative to native Fc-hinge domain SpA binding. Other methods of increasing serum half-life are known to those skilled in the art. Thus, in one embodiment, the antibody or fragment is PEGylated. In another embodiment, the antibody or fragment is fused to an albumin-bidnig domain, e.g. an albumin binding single domain antibody (dAb). In another embodiment, the antibody or fragment is PASylated (i.e. genetic fusion of polypeptide sequences composed of PAS (XL-Protein GmbH) which forms uncharged random coil structures with large hydrodynamic volume). In another embodiment, the antibody or fragment is XTENylated®/rPEGylated (i.e. genetic fusion of non-exact repeat peptide sequence (Amunix, Versartis) to the therapeutic peptide). In another embodiment, the antibody or fragment is ELPylated (i.e. genetic fusion to ELP repeat sequence (PhaseBio)). These various half-life extending fusions are described in more detail in Strohl, BioDrugs (2015) 29:215-239, which fusions, e.g. in Tables 2 and 6, are incorporated herein by reference.

The antibody may have a modified constant region which increases stability. Thus, in one embodiment, the heavy chain constant region comprises a Ser228Pro mutation. In another embodiment, the antibodies and fragments disclosed herein comprise a heavy chain hinge region that has been modified to alter the number of cysteine residues. This modification can be used to facilitate assembly of the light and heavy chains or to increase or decrease the stability of the antibody.

Concept 31. The antibody or fragment according to concept 30, wherein the constant region is a murine constant region.

In other embodiments, the constant region may be of any non-human mammalian origin, e.g. rat, mouse, hamster, guinea pig, dog, cat, horse, chicken, llama, dromedary, etc. In one embodiment, the constant region is a rat constant region. In another embodiment, the constant region is a llama constant region. The murine constant region may be any of the isotypes or alleles described hereinabove.

Concept 32. The antibody or fragment according to concept 30 or concept 31, wherein the constant region has CDC and/or ADCC activity.

Concept 33. The antibody according to any preceding concept wherein the:
  a) $V_H$ domain comprises an amino acid sequence of SEQ ID No:33 and the $V_L$ domain comprises an amino acid sequence of SEQ ID No:43;
  b) $V_H$ domain comprises an amino acid sequence that is at least 85% identical to SEQ ID No:33, and the $V_L$ domain comprises an amino acid sequence that is at least 85% identical to SEQ ID No:43;
  c) $V_H$ domain comprises an amino acid sequence of the $V_H$ domain of SEQ ID No:47 and the $V_L$ domain comprises an amino acid sequence of SEQ ID No:43;
  d) $V_H$ domain comprises an amino acid sequence of the $V_H$ domain of SEQ ID No:48 and the $V_L$ domain comprises an amino acid sequence of SEQ ID No:43;
  e) $V_H$ domain comprises an amino acid sequence of the $V_H$ domain of SEQ ID No:49 and the $V_L$ domain comprises an amino acid sequence of SEQ ID No:43;
  f) $V_H$ domain comprises an amino acid sequence of the $V_H$ domain of SEQ ID No:342 and the $V_L$ domain comprises an amino acid sequence of SEQ ID No:43;
  g) $V_H$ domain comprises an amino acid sequence of SEQ ID No:33 and the $V_L$ domain comprises an amino acid sequence of the $V_L$ domain of SEQ ID No:50;
  h) $V_H$ domain comprises an amino acid sequence of the $V_H$ domain of SEQ ID No:47 and the $V_L$ domain comprises an amino acid sequence of the $V_L$ domain of SEQ ID No:50;
  i) $V_H$ domain comprises an amino acid sequence of the $V_H$ domain of SEQ ID No:48 and the $V_L$ domain comprises an amino acid sequence of the $V_L$ domain of SEQ ID No:50; j) $V_H$ domain comprises an amino acid sequence of the $V_H$ domain of SEQ ID No:49 and the $V_L$ domain comprises an amino acid sequence of the $V_L$ domain of SEQ ID No:50;
  k) $V_H$ domain comprises an amino acid sequence of the $V_H$ domain of SEQ ID No:342 and the $V_L$ domain comprises an amino acid sequence of the $V_L$ domain of SEQ ID No:50;
  l) $V_H$ domain comprises an amino acid sequence of SEQ ID No:33 and the $V_L$ domain comprises an amino acid sequence of the $V_L$ domain of SEQ ID No:51;
  m) $V_H$ domain comprises an amino acid sequence of the $V_H$ domain of SEQ ID No:47 and the $V_L$ domain comprises an amino acid sequence of the $V_L$ domain of SEQ ID No:51;
  n) $V_H$ domain comprises an amino acid sequence of the $V_H$ domain of SEQ ID No:48 and the $V_L$ domain comprises an amino acid sequence of the $V_L$ domain of SEQ ID No:51;
  o) $V_H$ domain comprise an amino acid sequence of the $V_H$ domain of SEQ ID No:49 and the $V_L$ domain comprises an amino acid sequence of the $V_L$ domain of SEQ ID No:51;
  p) $V_H$ domain comprise an amino acid sequence of the $V_H$ domain of SEQ ID No:342 and the $V_L$ domain comprises an amino acid sequence of the $V_L$ domain of SEQ ID No:51;
  q) $V_H$ domain comprises an amino acid sequence of SEQ ID No:33 and the $V_L$ domain comprises an amino acid sequence of the $V_L$ domain of SEQ ID No:298;
  r) $V_H$ domain comprises an amino acid sequence of the $V_H$ domain of SEQ ID No:47 and the $V_L$ domain comprises an amino acid sequence of the $V_L$ domain of SEQ ID No:298;
  s) $V_H$ domain comprises an amino acid sequence of the $V_H$ domain of SEQ ID No:48 and the $V_L$ domain comprises an amino acid sequence of the $V_L$ domain of SEQ ID No:298;
  t) $V_H$ domain comprise an amino acid sequence of the $V_H$ domain of SEQ ID No:49 and the $V_L$ domain comprises an amino acid sequence of the $V_L$ domain of SEQ ID No:298;
  u) $V_H$ domain comprise an amino acid sequence of the $V_H$ domain of SEQ ID No:342 and the $V_L$ domain comprises an amino acid sequence of the $V_L$ domain of SEQ ID No:298;
  v) $V_H$ domain comprises an amino acid sequence of SEQ ID No:58 and the $V_L$ domain comprises an amino acid sequence of SEQ ID No:68;
  w) $V_H$ domain comprises an amino acid sequence that is at least 85% identical to SEQ ID No:58, and the $V_L$ domain comprise an amino acid sequence that is at least 85% identical to SEQ ID No:68;
  x) $V_H$ domain comprises an amino acid sequence of SEQ ID No:78 and the $V_L$ domain comprises an amino acid sequence of SEQ ID No:88;
  y) $V_H$ domain comprises an amino acid sequence that is at least 85% identical to SEQ ID No:78, and the $V_L$ domain comprises an amino acid sequence that is at least 85% identical to SEQ ID No:88;

z) V_H domain comprises an amino acid sequence of SEQ ID No:98 and the V_L domain comprises an amino acid sequence of SEQ ID No:108;
aa) V_H domain comprises an amino acid sequence that is at least 85% identical to SEQ ID No:98, and the V_L domain comprises an amino acid sequence that is at least 85% identical to SEQ ID No:108;
bb) V_H domain comprises an amino acid sequence of SEQ ID No:118 and the V_L domain comprises an amino acid sequence of SEQ ID No:128;
cc) V_H domain comprises an amino acid sequence that is at least 85% identical to SEQ ID No:118, and the V_L domain comprises an amino acid sequence that is at least 85% identical to SEQ ID No:128;
dd) V_H domain comprises an amino acid sequence of SEQ ID No:158 and the V_L domain comprises an amino acid sequence of SEQ ID No:168;
ee) V_H domain comprises an amino acid sequence that is at least 85% identical to SEQ ID No:158, and the V_L domain comprises an amino acid sequence that is at least 85% identical to SEQ ID No:168;
ff) V_H domain comprises an amino acid sequence of SEQ ID No:178 and the V_L domain comprises an amino acid sequence of SEQ ID No:188;
gg) V_H domain comprises an amino acid sequence that is at least 85% identical to SEQ ID No:178, and the V_L domain comprises an amino acid sequence that is at least 85% identical to SEQ ID No:188;
hh) V_H domain comprises an amino acid sequence of SEQ ID No:138 and the V_L domain comprises an amino acid sequence of SEQ ID No:148;
ii) V_H domain comprises an amino acid sequence that is at least 85% identical to SEQ ID No:138 and the V_L domain comprises an amino acid sequence that is at least 85% identical to SEQ ID No:148;
jj) V_H domain comprises an amino acid sequence of SEQ ID No:244 and the V_L domain comprises an amino acid sequence of SEQ ID No:254;
kk) V_H domain comprises an amino acid sequence that is at least 85% identical to SEQ ID No:244, and the V_L domain comprises an amino acid sequence that is at least 85% identical to SEQ ID No:254;
ll) V_H domain comprises an amino acid sequence of SEQ ID No:264 and the V_L domain comprises an amino acid sequence of SEQ ID No:274;
mm) V_H domain comprises an amino acid sequence that is at least 85% identical to SEQ ID No:264, and the V_L domain comprises an amino acid sequence that is at least 85% identical to SEQ ID No:274;
nn) V_H domain comprises an amino acid sequence of SEQ ID No:284 and the V_L domain comprises an amino acid sequence of SEQ ID No:294; and
oo) V_H domain comprises an amino acid sequence that is at least 85% identical to SEQ ID No:284, and the V_L domain comprises an amino acid sequence that is at least 85% identical to SEQ ID No:294;
pp) V_H domain comprises an amino acid sequence of SEQ ID No:349 and the V_L domain comprises an amino acid sequence of SEQ ID No:359; and
qq) V_H domain comprises an amino acid sequence that is at least 85% identical to SEQ ID No:349, and the V_L domain comprises an amino acid sequence that is at least 85% identical to SEQ ID No:359.

In one embodiment, the amino acid sequence is at least 70% identical to the specified Seq ID No. In one embodiment, the amino acid sequence is at least 75% identical to the specified Seq ID No. In one embodiment, the amino acid sequence is at least 95% identical to the specified Seq ID No. In one embodiment, the amino acid sequence is at least 96% identical to the specified Seq ID No. In one embodiment, the amino acid sequence is at least 97% identical to the specified Seq ID No. In one embodiment, the amino acid sequence is at least 98% identical to the specified Seq ID No. In one embodiment, the amino acid sequence is at least 99% identical to the specified Seq ID No. In one embodiment, the amino acid sequence is at least 99.5% identical to the specified Seq ID No.

Concept 34. The antibody according to any preceding concept wherein the antibody comprises a heavy chain and a light chain, and
a) the heavy chain amino acid sequence comprises an amino acid sequence of SEQ ID No:35 and the light chain amino acid sequence comprises an amino acid sequence of SEQ ID No:45;
b) the heavy chain amino acid sequence comprises an amino acid sequence that is at least 85% identical to SEQ ID No:35 and the light chain amino acid sequence comprises an amino acid sequence that is at least 85% identical to SEQ ID No:45;
c) the heavy chain amino acid sequence comprises an amino acid sequence of SEQ ID No:47 and the light chain amino acid sequence comprises an amino acid sequence of SEQ ID No:45;
d) the heavy chain amino acid sequence comprises an amino acid sequence of SEQ ID No:48 and the light chain amino acid sequence comprises an amino acid sequence of SEQ ID No:45;
e) the heavy chain amino acid sequence comprises an amino acid sequence of SEQ ID No:49 and the light chain amino acid sequence comprises an amino acid sequence of SEQ ID No:45;
f) the heavy chain amino acid sequence comprises an amino acid sequence of SEQ ID No:342 and the light chain amino acid sequence comprises an amino acid sequence of SEQ ID No:45;
g) the heavy chain amino acid sequence comprises an amino acid sequence of SEQ ID No:35 and the light chain amino acid sequence comprises an amino acid sequence of SEQ ID No:50;
h) the heavy chain amino acid sequence comprises an amino acid sequence of SEQ ID No:47 and the light chain amino acid sequence comprises an amino acid sequence of SEQ ID No:50;
i) the heavy chain amino acid sequence comprises an amino acid sequence of SEQ ID No:48 and the light chain amino acid sequence comprises an amino acid sequence of SEQ ID No:50;
j) the heavy chain amino acid sequence comprises an amino acid sequence of SEQ ID No:49 and the light chain amino acid sequence comprises an amino acid sequence of SEQ ID No:50;
k) the heavy chain amino acid sequence comprises an amino acid sequence of SEQ ID No:342 and the light chain amino acid sequence comprises an amino acid sequence of SEQ ID No:50;
l) the heavy chain amino acid sequence comprises an amino acid sequence of SEQ ID No:35 and the light chain amino acid sequence comprises an amino acid sequence of SEQ ID No:51;
m) the heavy chain amino acid sequence comprises an amino acid sequence of SEQ ID No:47 and the light chain amino acid sequence comprises an amino acid sequence of SEQ ID No:51;

n) the heavy chain amino acid sequence comprises an amino acid sequence of SEQ ID No:48 and the light chain amino acid sequence comprises an amino acid sequence of SEQ ID No:51;
o) the heavy chain amino acid sequence comprises an amino acid sequence of SEQ ID No:49 and the light chain amino acid sequence comprises an amino acid sequence of SEQ ID No:51;
p) the heavy chain amino acid sequence comprises an amino acid sequence of SEQ ID No:342 and the light chain amino acid sequence comprises an amino acid sequence of SEQ ID No:51;
q) the heavy chain amino acid sequence comprises an amino acid sequence of SEQ ID No:35 and the light chain amino acid sequence comprises an amino acid sequence of SEQ ID No:298;
r) the heavy chain amino acid sequence comprises an amino acid sequence of SEQ ID No:47 and the light chain amino acid sequence comprises an amino acid sequence of SEQ ID No:298;
s) the heavy chain amino acid sequence comprises an amino acid sequence of SEQ ID No:48 and the light chain amino acid sequence comprises an amino acid sequence of SEQ ID No:298;
t) the heavy chain amino acid sequence comprises an amino acid sequence of SEQ ID No:49 and the light chain amino acid sequence comprises an amino acid sequence of SEQ ID No:298;
u) the heavy chain amino acid sequence comprises an amino acid sequence of SEQ ID No:342 and the light chain amino acid sequence comprises an amino acid sequence of SEQ ID No:298;
v) the heavy chain amino acid sequence comprises an amino acid sequence of SEQ ID No:60 and the light chain amino acid sequence comprises an amino acid sequence of SEQ ID No:70;
w) the heavy chain amino acid sequence comprises an amino acid sequence that is at least 85% identical to SEQ ID No:60, and the light chain amino acid sequence comprises an amino acid sequence that is at least 85% identical to SEQ ID No:70;
x) the heavy chain amino acid sequence comprises an amino acid sequence of SEQ ID No:80 and the light chain amino acid sequence comprises an amino acid sequence of SEQ ID No:90;
y) the heavy chain amino acid sequence comprises an amino acid sequence that is at least 85% identical to SEQ ID No:80, and the light chain amino acid sequence comprises an amino acid sequence that is at least 85% identical to SEQ ID No:90;
z) the heavy chain amino acid sequence comprises an amino acid sequence of SEQ ID No:100 and the light chain amino acid sequence comprises an amino acid sequence of SEQ ID No:110;
aa) the heavy chain amino acid sequence comprises an amino acid sequence that is at least 85% identical to SEQ ID No:100, and the light chain amino acid sequence comprises an amino acid sequence that is at least 85% identical to SEQ ID No:110;
bb) the heavy chain amino acid sequence comprises an amino acid sequence of SEQ ID No:120 and the light chain amino acid sequence comprises an amino acid sequence of SEQ ID No:130;
cc) the heavy chain amino acid sequence comprises an amino acid sequence that is at least 85% identical to SEQ ID No:120, and the light chain amino acid sequence comprises an amino acid sequence that is at least 85% identical to SEQ ID No:130;
dd) the heavy chain amino acid sequence comprises an amino acid sequence of SEQ ID No:160 and the light chain amino acid sequence comprises an amino acid sequence of SEQ ID No:170;
ee) the heavy chain amino acid sequence comprises an amino acid sequence that is at least 85% identical to SEQ ID No:160, and the light chain amino acid sequence comprises an amino acid sequence that is at least 85% identical to SEQ ID No:170;
ff) the heavy chain amino acid sequence comprises an amino acid sequence of SEQ ID No:180 and the light chain amino acid sequence comprises an amino acid sequence of SEQ ID No:190;
gg) the heavy chain amino acid sequence comprises an amino acid sequence that is at least 85% identical to SEQ ID No:180, and the light chain amino acid sequence comprises an amino acid sequence that is at least 85% identical to SEQ ID No:190
hh) the heavy chain amino acid sequence comprises an amino acid sequence of SEQ ID No:140 and the light chain amino acid sequence comprises an amino acid sequence of SEQ ID No:150;
ii) the heavy chain amino acid sequence comprises an amino acid sequence that is at least 85% identical to SEQ ID No:140, and the light chain amino acid sequence comprises an amino acid sequence that is at least 85% identical to SEQ ID No:150;
jj) the heavy chain amino acid sequence comprises an amino acid sequence of SEQ ID No:246 and the light chain amino acid sequence comprises an amino acid sequence of SEQ ID No:256;
kk) the heavy chain amino acid sequence comprises an amino acid sequence that is at least 85% identical to SEQ ID No:246, and the light chain amino acid sequence comprises an amino acid sequence that is at least 85% identical to SEQ ID No:256;
ll) the heavy chain amino acid sequence comprises an amino acid sequence of SEQ ID No:266 and the light chain amino acid sequence comprises an amino acid sequence of SEQ ID No:276;
mm) the heavy chain amino acid sequence comprises an amino acid sequence that is at least 85% identical to SEQ ID No:266, and the light chain amino acid sequence comprises an amino acid sequence that is at least 85% identical to SEQ ID No:276;
nn) the heavy chain amino acid sequence comprises an amino acid sequence of SEQ ID No:286 and the light chain amino acid sequence comprises an amino acid sequence of SEQ ID No:296; and
oo) the heavy chain amino acid sequence comprises an amino acid sequence that is at least 85% identical to SEQ ID No:286, and the light chain amino acid sequence comprises an amino acid sequence that is at least 85% identical to SEQ ID No:296;
pp) the heavy chain amino acid sequence comprises an amino acid sequence of SEQ ID No:351 and the light chain amino acid sequence comprises an amino acid sequence of SEQ ID No:361; and
qq) the heavy chain amino acid sequence comprises an amino acid sequence that is at least 85% identical to SEQ ID No:351, and the light chain amino acid sequence comprises an amino acid sequence that is at least 85% identical to SEQ ID No:361.

In one embodiment, the amino acid sequence is at least 70% identical to the specified Seq ID No. In one embodiment, the amino acid sequence is at least 75% identical to the specified Seq ID No. In one embodiment, the amino acid sequence is at least 95% identical to the specified Seq ID No. In one embodiment, the amino acid sequence is at least 96% identical to the specified Seq ID No. In one embodiment, the amino acid sequence is at least 97% identical to the specified Seq ID No. In one embodiment, the amino acid sequence is at least 98% identical to the specified Seq ID No. In one embodiment, the amino acid sequence is at least 99% identical to the specified Seq ID No. In one embodiment, the amino acid sequence is at least 99.5% identical to the specified Seq ID No.

Concept 35. The antibody or fragment according to any preceding concept which competes for binding to hPD-L1 with the antibody 1D05, optionally wherein the competition for binding to hPD-L1 is conducted using SPR.

SPR may be carried out as described hereinabove, or as described in concept 16.

Concept 36. The antibody or fragment according to any preceding concept wherein the antibody or fragment is capable of inhibiting PD-L1-mediated suppression of T-cells, optionally wherein the suppression of T-cells is measured by an increase in one or more of IFNγ, IL-2, CD25 or proliferation of T-cells in an assay that provides co-stimulation by either direct CD3/CD28 stimulation, superantigen stimulation or provides co-stimulation by co-incubation with cells capable of inducing a T-cell response.

The measurements may be carried out with any suitable technique. For example, the measurements may be taken with ELISA, HTRF, BRDU incorporation (proliferation), electrochemiluminescence (ECL) or flow cytometry (e.g. FACS). These techniques are well-known to those skilled in the art and are described elsewhere herein. In one embodiment, the assay is flow cytometry. In one embodiment, the assay is ELISA. In one embodiment, the assay is HTRF.

In one embodiment, the suppression of T-cells is measured by an increase in IFNγ. In one embodiment, the suppression of T-cells is measured by an increase in IL-2. In one embodiment, the suppression of T-cells is measured by an increase in CD25. In one embodiment, the suppression of T-cells is measured by an increase in IFNγ and IL-2. In one embodiment, the suppression of T-cells is measured by an increase in IFNγ and CD25. In one embodiment, the suppression of T-cells is measured by an increase in CD25 and IL-2. In one embodiment, the suppression of T-cells is measured by an increase in IFNγ, IL-2 and CD25.

In one embodiment, the co-stimulation is provided by direct CD3/CD28 stimulation.

In one embodiment, the co-stimulation is provided by a superantigen, such as staphylococcal enterotoxin B (SEB).

In one embodiment, the assay provides co-stimulation by co-incubation with cells capable of inducing a T-cell response. Such cells may be antigen-presenting cells (APCs), for example monocytes, B-cells or dendritic cells. In one embodiment, the assay provides co-stimulation by co-incubation with APCs. In one embodiment, the assay provides co-stimulation by co-incubation with monocytes. In one embodiment, the assay provides co-stimulation by co-incubation with B-cells. In one embodiment, the assay provides co-stimulation by co-incubation with dendritic cells.

Concept 37. A bispecific antibody or fusion protein comprising an antibody or fragment thereof as defined in any preceding concept.

Concept 37a. A dual binding antibody or fusion protein comprising an antibody or fragment thereof as defined in any preceding concept.

A dual binding antibody has the meaning as set out above.

Concept 38. The bispecific antibody according to concept 37, wherein the bispecific format is selected from DVD-Ig, mAb$^2$, FIT-Ig, mAb-dAb, dock and lock, SEEDbody, scDiabody-Fc, diabody-Fc, tandem scFv-Fc, Fab-scFv-Fc, Fab-scFv, intrabody, BiTE, diabody, DART, TandAb, scDiabody, scDiabody-CH$_3$, Diabody-CH$_3$, minibody, knobs-in-holes, knobs-in-holes with common light chain, knobs-in-holes with common light chain and charge pairs, charge pairs, charge pairs with common light chain, in particular mAb$^2$, knob-in-holes, knob-in-holes with common light chain, knobs-in-holes with common light chain and charge pairs and FIT-Ig, e.g. mAb$^2$ and FIT-Ig.

In one embodiment, the bispecific format is selected from DVD-Ig, mAb$^2$, FIT-Ig, mAb-dAb, dock and lock, Fab-arm exchange, SEEDbody, Triomab, LUZ-Y, Fcab, κλ-body, orthogonal Fab, scDiabody-Fc, diabody-Fc, tandem scFv-Fc, Fab-scFv-Fc, Fab-scFv, intrabody, BiTE, diabody, DART, TandAb, scDiabody, scDiabody-CH$_3$, Diabody-CH$_3$, Triple body, Miniantibody, minibody, TriBi minibody, scFv-CH$_3$ KIH, scFv-CH-CL-scFv, F(ab')$_2$-scFv, scFv-KIH, Fab-scFv-Fc, tetravalent HCab, ImmTAC, knobs-in-holes, knobs-in-holes with common light chain, knobs-in-holes with common light chain and charge pairs, charge pairs, charge pairs with common light chain, DT-IgG, DutaMab, IgG(H)-scFv, scFv-(H)IgG, IgG(L)-scFv, scFv-(L)IgG, IgG(L,H)-Fv, IgG(H)-V, V(H)-IgG, IgG(L)-V, V(L)-IgG, KIH IgG-scFab, 2scFv-IgG, IgG-2scFv, scFv4-Ig and zybody.

In one embodiment, the bispecific format is selected from DVD-Ig, FIT-Ig, mAb-dAb, dock and lock, Fab-arm exchange, SEEDbody, Triomab, LUZ-Y, Fcab, κλ-body, orthogonal Fab, scDiabody-Fc, diabody-Fc, tandem scFv-Fc, Fab-scFv-Fc, Fab-scFv, intrabody, BiTE, diabody, DART, TandAb, scDiabody, scDiabody-CH$_3$, Diabody-CH$_3$, Triple body, Miniantibody, minibody, TriBi minibody, scFv-CH$_3$ KIH, scFv-CH-CL-scFv, F(ab')$_2$-scFv, scFv-KIH, Fab-scFv-Fc, tetravalent HCab, ImmTAC, knobs-in-holes, knobs-in-holes with common light chain, knobs-in-holes with common light chain and charge pairs, charge pairs, charge pairs with common light chain, DT-IgG, DutaMab, IgG(H)-scFv, scFv-(H)IgG, IgG(L)-scFv, scFv-(L)IgG, IgG(L,H)-Fv, IgG(H)-V, V(H)-IgG, IgG(L)-V, V(L)-IgG, KIH IgG-scFab, 2scFv-IgG, IgG-2scFv, scFv4-Ig and zybody, for example DVD-Ig, FIT-Ig, mAb-dAb, dock and lock, SEEDbody, scDiabody-Fc, diabody-Fc, tandem scFv-Fc, Fab-scFv-Fc, Fab-scFv, intrabody, BiTE, diabody, DART, TandAb, scDiabody, scDiabody-CH$_3$, Diabody-CH$_3$, minibody, knobs-in-holes, knobs-in-holes with common light chain, knobs-in-holes with common light chain and charge pairs, charge pairs, charge pairs with common light chain, in particular knob-in-holes, knob-in-holes with common light chain, knobs-in-holes with common light chain and charge pairs and FIT-Ig, e.g. FIT-Ig.

In one embodiment, the bispecific format is selected from DVD-Ig, mAb$^2$, mAb-dAb, dock and lock, Fab-arm exchange, SEEDbody, Triomab, LUZ-Y, Fcab, κλ-body, orthogonal Fab, scDiabody-Fc, diabody-Fc, tandem scFv-Fc, Fab-scFv-Fc, Fab-scFv, intrabody, BiTE, diabody, DART, TandAb, scDiabody, scDiabody-CH$_3$, Diabody-CH$_3$, Triple body, Miniantibody, minibody, TriBi minibody, scFv-CH$_3$ KIH, scFv-CH-CL-scFv, F(ab')$_2$-scFv, scFv-KIH, Fab-scFv-Fc, tetravalent HCab, ImmTAC, knobs-in-holes, knobs-in-holes with common light chain, knobs-in-holes with common light chain and charge pairs, charge pairs, charge pairs with common light chain, DT-IgG, DutaMab, IgG(H)-scFv, scFv-(H)IgG, IgG(L)-scFv, scFv-(L)IgG, IgG(L,H)-Fv, IgG(H)-V, V(H)-IgG, IgG(L)-V, V(L)-IgG, KIH IgG-scFab, 2scFv-IgG, IgG-2scFv, scFv4-Ig and zybody, for example DVD-Ig, mAb$^2$, mAb-dAb, dock and lock, SEEDbody, scDiabody-Fc, diabody-Fc, tandem scFv-Fc, Fab-scFv-Fc, Fab-scFv, intrabody, BiTE, diabody, DART, TandAb, scDiabody, scDiabody-CH$_3$, Diabody-CH$_3$, minibody, knobs-in-holes, knobs-in-holes with common light chain, knobs-in-holes with common light chain and charge pairs, charge pairs, charge pairs with common light chain, in particular mAb$^2$, knob-in-holes, knobs-in-holes with common light chain and charge pairs, and knob-in-holes with common light chain, e.g. mAb$^2$.

In one embodiment, the bispecific format is selected from DVD-Ig, mAb-dAb, dock and lock, Fab-arm exchange, SEEDbody, Triomab, LUZ-Y, Fcab, κλ-body, orthogonal Fab, scDiabody-Fc, diabody-Fc, tandem scFv-Fc, Fab-scFv-Fc, Fab-scFv, intrabody, BiTE, diabody, DART, TandAb, scDiabody, scDiabody-CH$_3$, Diabody-CH$_3$, Triple body, Miniantibody, minibody, TriBi minibody, scFv-CH$_3$ KIH, scFv-CH-CL-scFv, F(ab')$_2$-scFv, scFv-KIH, Fab-scFv-Fc, tetravalent HCab, ImmTAC, knobs-in-holes, knobs-in-holes with common light chain, knobs-in-holes with common light chain and charge pairs, charge pairs, charge pairs with common light chain, DT-IgG, DutaMab, IgG(H)-scFv, scFv-(H)IgG, IgG(L)-scFv, scFv-(L)IgG, IgG(L,H)-Fv, IgG(H)-V, V(H)-IgG, IgG(L)-V, V(L)-IgG, KIH IgG-scFab, 2scFv-IgG, IgG-2scFv, scFv4-Ig and zybody, for example DVD-Ig, mAb-dAb, dock and lock, SEEDbody, scDiabody-Fc, diabody-Fc, tandem scFv-Fc, Fab-scFv-Fc, Fab-scFv, intrabody, BiTE, diabody, DART, TandAb, scDiabody, scDiabody-CH$_3$, Diabody-CH$_3$, minibody, knobs-in-holes, knobs-in-holes with common light chain, knobs-in-holes with common light chain and charge pairs, charge pairs, charge pairs with common light chain, in particular knob-in-holes, knobs-in-holes with common light chain and charge pairs, and knob-in-holes with common light chain.

Concept 39. The bispecific antibody according to concept 37 or concept 38, wherein the bispecific antibody specifically binds to hPD-L1 and another target antigen selected from immune checkpoint inhibitors (such as PD-1, CTLA-4, TIGIT, TIM-3, LAG-3 and VISTA, e.g. TIGIT, TIM-3 and LAG-3), immune modulators (such as BTLA, hHVEM, CSF1R, CCR4, CD39, CD40, CD73, CD96, CXCR2, CXCR4, CD200, GARP, SIRPα, CXCL9, CXCL10, CXCL11 and CD155, e.g. GARP, SIRPα, CXCR4, BTLA, hVEM and CSF1R), immune activators (such as CD137, GITR, OX40, CD40, CXCR3 (e.g. agonistic anti-CXCR3 antibodies), CD27, CD3, ICOS (e.g. agonistic anti-ICOS antibodies), for example. ICOS, CD137, GITR and OX40).

Concept 39a. A bispecific antibody which binds to hPD-L1 with a V$_H$, a V$_L$, or a paired V$_H$ and V$_L$ comprising one or more of the CDRs (e.g. CDRH3 and CDRL3) or variable region sequences of any of the antibodies described in Aspect 1a hereinbelow, and another target antigen selected from immune checkpoint inhibitors (such as PD-1, CTLA-4, TIGIT, TIM-3, LAG-3 and VISTA, e.g. TIGIT, TIM-3 and LAG-3), immune modulators (such as BTLA, hHVEM, CSF1R, CCR4, CD39, CD40, CD73, CD96, CXCR2, CXCR4, CD200, GARP, SIRPα, CXCL9, CXCL10, CXCL11 and CD155, e.g. GARP, SIRPα, CXCR4, BTLA, hVEM and CSF1R), immune activators (such as CD137, GITR, OX40, CD40, CXCR3 (e.g. agonistic anti-CXCR3 antibodies), CD27, CD3, ICOS (e.g. agonistic anti-ICOS antibodies), for example. ICOS, CD137, GITR and OX40).

Concept 39b. The bispecific antibody according to concept 37 or concept 38, wherein the bispecific antibody specifically binds to hPD-L1 and another target antigen selected from immune checkpoint inhibitors (such as PD-1, CTLA-4, TIGIT, TIM-3, LAG-3 and VISTA, e.g. TIGIT, TIM-3 and LAG-3), immune modulators (such as BTLA, hHVEM, CSF1R, CCR4, CD39, CD40, CD73, CD96, CXCR2, CXCR4, CD200, GARP, SIRPα, CXCL9, CXCL10 and CD155, e.g. GARP, SIRPα, CXCR4, BTLA, hVEM and CSF1R), immune activators (such as CD137, GITR, OX40, CD40, CXCR3 (e.g. agonistic anti-CXCR3 antibodies), CD3, ICOS (e.g. agonistic anti-ICOS antibodies), for example. ICOS, CD137, GITR and OX40).

In one embodiment, the another target antigen is an immune checkpoint inhibitor, such as PD-1, CTLA-4, TIGIT, TIM-3, LAG-3 and VISTA, e.g. TIGIT, CTLA-4, TIM-3 and LAG-3. In one embodiment, the another target antigen is an immune modulator, such as BTLA, hHVEM, CSF1R, CCR4, CD39, CD40, CD73, CD96, CXCR2, CXCR4, CD200, GARP, SIRPα, CXCL9, CXCL10, CXCL11 and CD155, or such as such as BTLA, hHVEM, CSF1R, CCR4, CD39, CD40, CD73, CD96, CXCR2, CXCR4, CD200, GARP, SIRPα, CXCL9, CXCL10 and CD155 e.g. GARP, SIRPα, CXCR4, BTLA, hVEM and CSF1R. In one embodiment, the another target antigen is an immune activator, such as CD137, GITR, OX40, CD40, CXCR3 (e.g. agonistic anti-CXCR3 antibodies), CD27, CD3 and ICOS (e.g. agonistic anti-ICOS antibodies), or CD137, GITR, OX40, CD40, CXCR3 (e.g. agonistic anti-CXCR3 antibodies), CD3 and ICOS (e.g. agonistic anti-ICOS antibodies), for example ICOS, CD137, GITR and OX40). In one embodiment, the another target antigen is CTLA-4. In one embodiment, the another target antigen is TIGIT. In one embodiment, the another target antigen is TIM-3. In one embodiment, the another target antigen is LAG-3. In one embodiment, the another target antigen is GITR. In one embodiment, the another target antigen is VISTA. In one embodiment, the another target antigen is CD137. In one embodiment, the another target antigen is SIRPα. In one embodiment, the another target antigen is CXCL10. In one embodiment, the another target antigen is CD155. In one embodiment, the another target antigen is CD40.

In another embodiment, the bispecific antibody binds another target antigen which is PD-1 and the binding to PD-1 is provided by an antigen-binding domain (for example, a V$_H$, a V$_L$ or a paired V$_H$ and V$_L$) having any of the sequences, including CDR sequences (for example CDRH3 and/or CDRL3) or variable region sequences as described in Aspect 1A hereinbelow.

In another embodiment, the bispecific antibody binds another target antigen which is CTLA4 and the binding to CTLA4 is provided by an antigen-binding domain (for example, a V$_H$, a V$_L$ or a paired V$_H$ and V$_L$) having any of the sequences, including CDR sequences (for example CDRH3 and/or CDRL3) or variable region sequences as described in Aspect 1A hereinbelow.

In another embodiment, the bispecific antibody binds another target antigen which is TIGIT and the binding to TIGIT is provided by an antigen-binding domain (for example, a V$_H$, a V$_L$ or a paired V$_H$ and V$_L$) having any of the sequences, including CDR sequences (for example CDRH3 and/or CDRL3) or variable region sequences as described in Aspect 1A hereinbelow.

In another embodiment, the bispecific antibody binds another target antigen which is TIM-3 and the binding to TIM-3 is provided by an antigen-binding domain (for example, a V$_H$, a V$_L$ or a paired V$_H$ and V$_L$) having any of the sequences, including CDR sequences (for example CDRH3 and/or CDRL3) or variable region sequences as described in Aspect 1A hereinbelow.

In another embodiment, the bispecific antibody binds another target antigen which is LAG3 and the binding to LAG3 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is VISTA and the binding to VISTA is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is BTLA and the binding to BTLA is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is hHVEM and the binding to hHVEM is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is CSF1R and the binding to CSF1R is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is CCR4 and the binding to CCR4 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is CD39 and the binding to CD39 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is CD40 and the binding to CD40 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is CD73 and the binding to CD73 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is CD96 and the binding to CD96 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is CXCR2 and the binding to CXCR2 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is CXCR4 and the binding to CXCR4 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is CD200 and the binding to CD200 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is GARP and the binding to GARP is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is SIRPα and the binding to SIRPα is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is CXCL9 and the binding to CXCL9 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is CXCL10 and the binding to CXCL10 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is CXCL11 and the binding to CXCL11 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is CD155 and the binding to CD155 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is CD137 and the binding to CD137 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is GITR and the binding to GITR is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is OX40 and the binding to OX40 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is CD40 and the binding to CD40 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is CXCR3 and the binding to CXCR3 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is CD27 and the binding to CD27 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is CD3 and the binding to CD3 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the bispecific antibody binds another target antigen which is ICOS and the binding to ICOS is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in arrangement 5 and arrangement 5a hereinbelow, and any of the anti-ICOS antibodies described in sentences 1 to 102 and sentences 1a to 21a.

In one embodiment, the bispecific antibody has a FIT-Ig format which comprises a full antibody (e.g. an antibody comprising a light chain comprising a $V_L$ and $C_L$ and a heavy chain comprising $V_H$, $CH_1$, $CH_2$ and $CH_3$) which binds hPD-L1 (optionally wherein the antibody has a structure as defined in any one of concepts 1 to 40, or wherein the antibody has a sequence—including CDRs and variable regions—as defined in Aspect 1a hereinbelow) and a Fab which binds GITR (optionally wherein the GITR Fab has a sequence—including CDRs and variable regions—as defined in Aspect 1a hereinbelow). In one embodiment, the bispecific antibody has a FIT-Ig format which comprises a full antibody (e.g. an antibody comprising a light chain comprising a $V_L$ and $C_L$ and a heavy chain comprising $V_H$, $CH_1$, $CH_2$ and $CH_3$) which binds GITR (optionally wherein the GITR antibody has a sequence—including CDRs and variable regions—as defined in Aspect 1a hereinbelow) and a Fab which binds hPD-L1 (optionally wherein the antibody has a structure as defined in any one of concepts 1 to 40, or wherein the antibody has a sequence—including CDRs and variable regions—as defined in Aspect 1a hereinbelow). In one embodiment, the FIT-Ig is effector-enabled (e.g. as described in any of concepts 30 to 32). In another embodiment, the FIT-Ig is effector-disabled (e.g. is an IgG4 format, or as described in any of concepts 30 to 31).

In one embodiment, the bispecific antibody has a FIT-Ig format which comprises a full antibody (e.g. an antibody comprising a light chain comprising a $V_L$ and $C_L$ and a heavy chain comprising $V_H$, $CH_1$, $CH_2$ and $CH_3$) which binds hPD-L1 (optionally wherein the antibody has a structure as defined in any one of concepts 1 to 40, or wherein the antibody has a sequence—including CDRs and variable regions—as defined in Aspect 1a hereinbelow) and a Fab which binds ICOS (e.g. binds with agonistic activity and optionally wherein the ICOS Fab has a sequence—including CDRs and variable regions—as defined in arrangement 5, or in arrangement 5a, or in sentences 1 to 102, or in sentences 1a to 21a hereinbelow). In one embodiment, the ICOS Fab has a sequence of any of the ICOS antibodies described herein in sentences 1 to 102 or in sentences 1a to 21a) In one embodiment, the bispecific antibody has a FIT-Ig format which comprises a full antibody (e.g. an antibody comprising a light chain comprising a $V_L$ and $C_L$ and a heavy chain comprising $V_H$, $CH_1$, $CH_2$ and $CH_3$) which binds ICOS (e.g. binds with agonistic activity or optionally wherein the ICOS antibody has a sequence—including CDRs and variable regions—as defined in arrangement 5, or in arrangement 5a, or in sentences 1 to 102, or in sentences 1a to 21a hereinbelow) and a Fab which binds hPD-L1 (optionally wherein the antibody has a structure as defined in any one of concepts 1 to 40, or wherein the antibody has a sequence—including CDRs and variable regions—as defined in Aspect 1A hereinbelow). In one embodiment, the FIT-Ig is effector-enabled (e.g. as described in any of concepts 30 to 32). In another embodiment, the FIT-Ig is effector-disabled (e.g. is an IgG4 format, or as described in any of concepts 30 or 31).

In one embodiment, the bispecific antibody has a FIT-Ig format which comprises a full antibody (e.g. an antibody comprising a light chain comprising a $V_L$ and $C_L$ and a heavy chain comprising $V_H$, $CH_1$, $CH_2$ and $CH_3$) which binds hPD-L1 (optionally wherein the antibody has a structure as defined in any one of concepts 1 to 40, or wherein the antibody has a sequence—including CDRs and variable regions—as defined in Aspect 1a hereinbelow) and a Fab which binds TIM-3 (optionally wherein the TIM-3 Fab has a sequence—including CDRs and variable regions—as defined in Aspect 1a hereinbelow). In one embodiment, the bispecific antibody has a FIT-Ig format which comprises a full antibody (e.g. an antibody comprising a light chain comprising a $V_L$ and $C_L$ and a heavy chain comprising $V_H$, $CH_1$, $CH_2$ and $CH_3$) which binds TIM-3 (optionally wherein the TIM-3 antibody has a sequence—including CDRs and variable regions—as defined in Aspect 1a hereinbelow) and a Fab which binds hPD-L1 (optionally wherein the antibody has a structure as defined in any one of concepts 1 to 40, or wherein the antibody has a sequence—including CDRs and variable regions—as defined in Aspect 1a hereinbelow). In one embodiment, the FIT-Ig is effector-enabled (e.g. as described in any of concepts 30 to 32). In another embodiment, the FIT-Ig is effector-disabled (e.g. is an IgG4 format, or as described in any of concepts 30 or 31).

In one embodiment, the bispecific antibody has a FIT-Ig format which comprises a full antibody (e.g. an antibody comprising a light chain comprising a $V_L$ and $C_L$ and a heavy chain comprising $V_H$, $CH_1$, $CH_2$ and $CH_3$) which binds hPD-L1 (optionally wherein the antibody has a structure as defined in any one of concepts 1 to 40, or wherein the antibody has a sequence—including CDRs and variable regions—as defined in Aspect 1a hereinbelow) and a Fab which binds CD137 (optionally wherein the CD137 Fab has a sequence—including CDRs and variable regions—as defined in Aspect 1a hereinbelow). In one embodiment, the bispecific antibody has a FIT-Ig format which comprises a full antibody (e.g. an antibody comprising a light chain comprising a $V_L$ and $C_L$ and a heavy chain comprising $V_H$, $CH_1$, $CH_2$ and $CH_3$) which binds CD137 (optionally wherein the CD137 antibody has a sequence—including CDRs and variable regions—as defined in Aspect 1a hereinbelow) and a Fab which binds hPD-L1 (optionally wherein the antibody has a structure as defined in any one of concepts 1 to 40, or wherein the antibody has a sequence—including CDRs and variable regions—as defined in Aspect 1a hereinbelow). In one embodiment, the FIT-Ig is effector-enabled (e.g. as described in any of concepts 30 to 32). In another embodiment, the FIT-Ig is effector-disabled (e.g. is an IgG4 format, or as described in any of concepts 30 or 31).

In one embodiment, the bispecific antibody has a FIT-Ig format which comprises a full antibody (e.g. an antibody comprising a light chain comprising a $V_L$ and $C_L$ and a heavy chain comprising $V_H$, $CH_1$, $CH_2$ and $CH_3$) which binds hPD-L1 (optionally wherein the antibody has a structure as defined in any one of concepts 1 to 40, or wherein the antibody has a sequence—including CDRs and variable regions—as defined in Aspect 1a hereinbelow) and a Fab which binds CD3 (optionally wherein the CD3 Fab has a sequence—including CDRs and variable regions—as defined in Aspect 1a hereinbelow). In one embodiment, the bispecific antibody has a FIT-Ig format which comprises a full antibody (e.g. an antibody comprising a light chain comprising a $V_L$ and $C_L$ and a heavy chain comprising $V_H$, $CH_1$, $CH_2$ and $CH_3$) which binds CD3 (optionally wherein the CD3 antibody has a sequence—including CDRs and variable regions—as defined in Aspect 1a hereinbelow) and a Fab which binds hPD-L1 (optionally wherein the antibody has a structure as defined in any one of concepts 1 to 40, or wherein the antibody has a sequence—including CDRs and variable regions—as defined in Aspect 1a hereinbelow). In one embodiment, the FIT-Ig is effector-enabled (e.g. as described in any of concepts 30 to 32). In another embodiment, the FIT-Ig is effector-disabled (e.g. is an IgG4 format, or as described in any of concepts 30 or 31).

Any of the targets listed above (and the Fabs and/or full antibodies described in more detail in Aspect 1A or anti-TIGIT antibodies described below) may be applied to the FIT-Ig structure.

Concept 40. The bispecific antibody according to concept 39, wherein the another target antigen is TIGIT or LAG3.

In any of concepts 37 to 40, if the antibody or fragment thereof has the heavy and light variable region sequences of 84G09, then the bispecific antibody shall be interpreted as not including a $mAb^2$ format wherein the Fcab has binding affinity to LAG3.

In one embodiment, the bispecific antibody has a FIT-Ig format which comprises a full antibody (e.g. an antibody comprising a light chain comprising a $V_L$ and $C_L$ and a heavy chain comprising $V_H$, $C_H1$, $C_H2$ and $C_H3$) which binds hPD-L1 (optionally wherein the antibody has a structure as defined in any one of concepts 1 to 40, or wherein the antibody has a sequence—including CDRs and variable regions—as defined in Aspect 1a hereinbelow) and a Fab which binds TIGIT (optionally wherein the TIGIT Fab has a sequence—including CDRs and variable regions—as defined in Aspect 1a hereinbelow). In one embodiment, the bispecific antibody has a FIT-Ig format which comprises a full antibody (e.g. an antibody comprising a light chain comprising a $V_L$ and $C_L$ and a heavy chain comprising $V_H$, $CH_1$, $CH_2$ and $CH_3$) which binds TIGIT (optionally wherein the TIGIT antibody has a sequence—including CDRs and variable regions—as defined in Aspect 1a hereinbelow) and a Fab which binds hPD-L1 (optionally wherein the antibody has a structure as defined in any one of concepts 1 to 40, or wherein the antibody has a sequence—including CDRs and variable regions—as defined in Aspect 1a hereinbelow). In one embodiment, the FIT-Ig is effector-enabled (e.g. as described in any of concepts 30 to 32). In another embodiment, the FIT-Ig is effector-disabled (e.g. is an IgG4 format, or as described in any of concepts 30 or 31).

In one embodiment, the bispecific antibody has a FIT-Ig format which comprises a full antibody (e.g. an antibody comprising a light chain comprising a $V_L$ and $C_L$ and a heavy chain comprising $V_H$, $C_H1$, $C_H2$ and $C_H3$) which binds hPD-L1 (optionally wherein the antibody has a structure as defined in any one of concepts 1 to 40, or wherein the antibody has a sequence—including CDRs and variable regions—as defined in Aspect 1a hereinbelow) and a Fab which binds LAG3 (optionally wherein the LAG3 Fab has a sequence—including CDRs and variable regions—as defined in Aspect 1a hereinbelow). In one embodiment, the bispecific antibody has a FIT-Ig format which comprises a full antibody (e.g. an antibody comprising a light chain comprising a $V_L$ and $C_L$ and a heavy chain comprising $V_H$, $C_H1$, $C_H2$ and $C_H3$) which binds LAG3 (optionally wherein the LAG3 antibody has a sequence—including CDRs and variable regions—as defined in Aspect 1a hereinbelow) and a Fab which binds hPD-L1 (optionally wherein the antibody has a structure as defined in any one of concepts 1 to 40, or wherein the antibody has a sequence—including CDRs and variable regions—as defined in Aspect 1a hereinbelow). In one embodiment, the FIT-Ig is effector-enabled (e.g. as described in any of concepts 30 to 32). In another embodiment, the FIT-Ig is effector-disabled (e.g. is an IgG4 format, or as described in any of concepts 30 or 31).

Concept 41. An antibody or fragment as defined in any preceding concept for use in treating or preventing a hPD-L1-mediated disease or condition, e.g. selected from neoplastic or non-neoplastic disease, chronic viral infections, and malignant tumours, such as melanoma, Merkel cell carcinoma, non-small cell lung cancer (squamous and non-squamous), renal cell cancer, bladder cancer, head and neck squamous cell carcinoma, mesothelioma, virally induced cancers (such as cervical cancer and nasopharyngeal cancer), soft tissue sarcomas, haematological malignancies such as Hodgkin's and non-Hodgkin's disease and diffuse large B-cell lymphoma). (for example melanoma, Merkel cell carcinoma, non-small cell lung cancer (squamous and non-squamous), renal cell cancer, bladder cancer, head and neck squamous cell carcinoma and mesothelioma or for example virally induced cancers (such as cervical cancer and nasopharyngeal cancer) and soft tissue sarcomas).

Concept 42. Use of an antibody or fragment as defined in any one of concepts 1 to 40 in the manufacture of a medicament for administration to a human for treating or preventing a hPD-L1 mediated disease or condition in the human, e.g. selected from neoplastic or non-neoplastic disease, chronic viral infections, and malignant tumours, such as melanoma, Merkel cell carcinoma, non-small cell lung cancer (squamous and non-squamous), renal cell cancer, bladder cancer, head and neck squamous cell carcinoma, mesothelioma, virally induced cancers (such as cervical cancer and nasopharyngeal cancer), soft tissue sarcomas, haematological malignancies such as Hodgkin's and non-Hodgkin's disease and diffuse large B-cell lymphoma (for example melanoma, Merkel cell carcinoma, non-small cell lung cancer (squamous and non-squamous), renal cell cancer, bladder cancer, head and neck squamous cell carcinoma and mesothelioma or for example virally induced cancers (such as cervical cancer and nasopharyngeal cancer) and soft tissue sarcomas).

Concept 43. A method of treating or preventing a hPD-L1 mediated disease or condition, e.g. selected from neoplastic or non-neoplastic disease, chronic viral infections, and malignant tumours, such as melanoma, Merkel cell carcinoma, non-small cell lung cancer (squamous and non-squamous), renal cell cancer, bladder cancer, head and neck squamous cell carcinoma, mesothelioma, virally induced cancers (such as cervical cancer and nasopharyngeal cancer), soft tissue sarcomas, haematological malignancies such as Hodgkin's and non-Hodgkin's disease and diffuse large B-cell lymphoma (for example melanoma, Merkel cell carcinoma, non-small cell lung cancer (squamous and non-squamous), renal cell cancer, bladder cancer, head and neck squamous cell carcinoma and mesothelioma or for example virally induced cancers (such as cervical cancer and nasopharyngeal cancer) and soft tissue sarcomas) in a human, comprising administering to said human a therapeutically effective amount of an antibody or fragment as defined in any one of concepts 1 to 40, wherein the hPD-L1 mediated disease or condition is thereby treated or prevented.

In any of concepts 41 to 43, the hPD-L1 mediated disease may be any of those as described herein. In one embodiment, in any of concepts 41 to 43, the hPD-L1 mediated disease is a virally induced cancer, such as cervical cancer and nasopharyngeal cancer, for example cervical cancers caused by HPV infection. In one embodiment, in any of concepts 41 to 43, the hPD-L1 mediated disease is a chronic viral infection. In one embodiment, in any of concepts 41 to 43, the hPD-L1 mediated disease is a neoplastic disease. In one embodiment, in any of concepts 41 to 43, the hPD-L1 mediated disease is a non-neoplastic disease. In one embodiment, in any of concepts 41 to 43, the hPD-L1 mediated disease is a malignant tumour. In one embodiment, in any of concepts 41 to 43, the hPD-L1 mediated disease is a cancer which is known to be responsive to PD-L1 therapy, such as melanoma, Merkel cell carcinoma, non-small cell lung cancer (squamous and non-squamous), renal cell cancer, bladder cancer, head and neck squamous cell carcinoma, mesothelioma. In one embodiment, in any of concepts 41 to 43, the hPD-L1 mediated disease is a cancer which is a soft tissue sarcoma.

Concept 44. The antibody or fragment according to concept 41, the use according to concept 42 or the method according to concept 43, wherein the hPD-L1-mediated disease or condition is cancer.

Concept 44a. The antibody or fragment according to concept 41, the use according to concept 42 or the method according to concept 43, wherein the hPD-L1-mediated disease or condition is a neurodegenerative disease, disorder or condition, optionally wherein the neurodegenerative disease, disorder or condition is selected from Alzheimer's disease, amyotrophic lateral sclerosis, Parkinson's disease, Huntington's disease, primary progressive multiple sclerosis, secondary progressive multiple sclerosis, corticobasal degeneration, Rett syndrome, a retinal degeneration disorder selected from age-related macular degeneration and retinitis pigmentosa; anterior ischemic optic neuropathy, glaucoma, uveitis, depression, trauma-associated stress or post-traumatic stress disorder, frontotemporal dementia, Lewy body dementias, mild cognitive impairments, posterior cortical atrophy, primary progressive aphasia and progressive supranuclear palsy or aged-related dementia, in particular Alzheimer's disease, amyotrophic lateral sclerosis, Parkinson's disease and Huntington's disease, and e.g. Alzheimer's disease.

In concept 44a, the therapeutically effective amount of an antibody or fragment may comprise an antigen-binding site that specifically binds PD-L1, e.g. hPD-L1.

In one embodiment, the antigen-binding site specifically binds PD-L1, e.g. hPD-L1. In one embodiment, the PD-L1 antigen-binding site comprises the CDRH1, CDRH2, CDR3, CDRL1, CDRL2 and CDRL3, or the $V_H$, or the $V_L$ or the $V_H$ and $V_L$ region from any one of the anti-PD-L1 antibodies selected from atezolizumab (Roche), avelumab (Merck), BMS-936559/MDX-1105 (BMS), durvalumab/Medi4736 (Medimmune), KN-035, CA-170, FAZ-053 M7824, ABBV-368, LY-3300054, GNS-1480, YW243.55.S70, REGN3504 and any of the PD-L1 antibodies disclosed in WO2017/034916, WO2017/020291, WO2017/020858, WO2017/020801, WO2016/111645, WO2016/197367, WO2016/061142, WO2016/149201, WO2016/000619, WO2016/160792, WO2016/022630, WO2016/007235, WO2015/179654, WO2015/173267, WO2015/181342, WO2015/109124, WO2015/112805, WO2015/061668, WO2014/159562, WO2014/165082, WO2014/100079, WO2014/055897, WO2013/181634, WO2013/173223, WO2013/079174, WO2012/145493, WO2011/066389, WO2010/077634, WO2010/036959, WO2010/089411 or WO2007/005874, which antibodies and sequences are incorporated herein by reference.

In another embodiment of concept 44a, the PD-L1 antigen-binding site comprises the CDRH1, CDRH2, CDR3, CDRL1, CDRL2 and CDRL3, or the $V_H$, or the $V_L$ or the $V_H$ and $V_L$ region from any one of the anti-PD-L1 antibodies selected from an anti-PD-L1 antibody disclosed herein, particularly the anti-PD-L1 antibody clones disclosed in concepts 16a through 16l, and more particularly anti-PD-L1 antibody clone 84G09.

In another embodiment of concept 44a, the PD-L1 antigen-binding site comprises the CDRH1, CDRH2, CDR3, CDRL1, CDRL2 and CDRL3, or the $V_H$, or the $V_L$ or the $V_H$ and $V_L$ region from anti-PD-L1 antibody clone 84G09 and the hPD-L1-mediated disease or condition is Alzheimer's disease.

Concept 45. The antibody or fragment, the use or the method according to concept 44, wherein the cancer is selected from melanoma, Merkel cell carcinoma, non-small cell lung cancer (squamous and non-squamous), renal cell cancer, bladder cancer, head and neck squamous cell carcinoma and mesothelioma or is selected from virally induced cancers (such as cervical cancer and nasopharyngeal cancer) and soft tissue sarcomas.

Concept 46. The antibody or fragment, use or the method according to any one of concepts 41 to 45, further comprising administering to the human a further therapy, for example a further therapeutic agent, optionally wherein the further therapeutic agent is independently selected from the group consisting of:
  a. other immune checkpoint inhibitors (such as anti-TIM-3 antibodies, anti-CTLA-4 antibodies, anti-TIGIT antibodies and anti-LAG-3 antibodies);
  b. immune stimulators (such as anti-OX40 antibodies, anti-GITR antibodies, anti-CD137 antibodies, anti-ICOS antibodies and anti-CD40 antibodies);
  c. chemokine receptor antagonists (such as CXCR4, CCR4 and CXCR2);
  d. targeted kinase inhibitors (such as CSF-1R or VEGFR inhibitors);
  e. angiogenesis inhibitors (such as anti-VEGF-A or Delta-like Ligand-4);
  f. immune stimulating peptides or chemokines (such as CXCL9 or CXCL10);
  g. cytokines (such as IL-15 and IL-21);
  h. bispecific T-cell engagers (BiTEs) having at least one specificity against CD3 (e.g. CD3/CD19 BiTE);
  i. other bi-specific molecules (for example IL-15-containing molecules targeted towards tumour associated antigens, for example Epidermal growth factor receptors such as EGFR, Her-2, New York Esophageal Cancer-1 (NY-ESO-1), GD2, EpCAM or Melanoma Associated Antigen-3 (MAGE-A3));
  j. oncolytic viruses (such as HSV virus (optionally which secretes GMCSF), Newcastle disease virus and Vaccinia virus);
  k. vaccination with tumour associated antigens (such as New York Esophageal Cancer-1 [NY-ESO-1], Melanoma Associated Antigen-3 [MAGE-3]);
  l. cell-based therapies (such as chimeric Antigen Receptor-T-cells (CAR-T) for example expressing anti-CD19, anti-EpCam or anti-mesothelin);
  m. bi-specific NK cell engagers having a specificity against an activating MK receptor such as NKG2D or CD16a; and
  n. adoptive transfer of tumour specific T-cells or LAK cells, or optionally wherein the further therapy is chemotherapy, radiotherapy and surgical removal of tumours.

Radiotherapy may be single dose or in fractionated doses, either delivered to affected tissues directly or to the whole body.

Chemotherapeutic agents may any as described hereinabove, in particular, agents that induce immunogenic cell death, for example platinum therapies, such as oxaliplatin. In one embodiment, the chemotherapy is a standard of care cytotoxic chemotherapy for the cancer being treated.

In this aspect, the bispecific molecules include "bispecific antibodies" and antibody fusion proteins, including those formats and molecules described in concepts 37 to 40.

The antibodies may be any of the sequences or antibodies described in arrangement 5, 5a or detailed in Aspect 1a.

The further therapeutic agents of this concept may be delivered by any method, which methods are well-known to those skilled in the art. For example, the further therapeutic agents may be delivered orally, systemically or locally (to the tumour environment). In one embodiment, the further therapeutic agent is delivered orally. In one embodiment, the further therapeutic agent is delivered systemically (e.g. intravenously). In one embodiment, the further therapeutic agent is delivered locally to the tumour environment.

Compositions and routes of administration are described in more detail hereinbelow.

Concept 47. The antibody or fragment, use or the method according to concept 46, wherein the further therapeutic agent is administered sequentially or simultaneously with the anti-hPD-L1 antibody or fragment.

Concept 48. A pharmaceutical composition comprising an antibody of fragment as defined in any one of concepts 1 to 40 and a pharmaceutically acceptable excipient, diluent or carrier and optionally further comprising a further therapeutic agent independently selected from the group consisting of:
  a) other immune checkpoint inhibitors (such as anti-TIM-3 antibodies, anti-CTLA-4 antibodies, anti-TIGIT antibodies and anti-LAG-3 antibodies);
  b) immune stimulators (such as anti-OX40 antibodies, anti-GITR antibodies, anti-CD137 antibodies, anti-ICOS antibodies and anti-CD40 antibodies);
  c) chemokine receptor antagonists (such as CXCR4, CCR4 and CXCR2);
  d) targeted kinase inhibitors (such as CSF-1R or VEGFR inhibitors);
  e) angiogenesis inhibitors (such as anti-VEGF-A or Delta-like Ligand-4);
  f) immune stimulating peptides or chemokines (such as CXCL9 or CXCL10);
  g) cytokines (such as IL-15 and IL-21);
  h) bispecific T-cell engagers (BiTEs) having at least one specificity against CD3 (e.g. CD3/CD19 BiTE);
  i) other bi-specific molecules (for example IL-15-containing molecules targeted towards tumour associated antigens, for example Epidermal growth factor receptors such as EGFR, Her-2, New York Esophageal Cancer-1 (NY-ESO-1), GD2, EpCAM or Melanoma Associated Antigen-3 (MAGE-A3));
  j) oncolytic viruses (such as HSV virus (optionally which secretes GMCSF), Newcastle disease virus and Vaccinia virus);
  k) vaccination with tumour associated antigens (such as New York Esophageal Cancer-1 [NY-ESO-1], Melanoma Associated Antigen-3 [MAGE-3]);
  l) cell-based therapies (such as chimeric Antigen Receptor-T-cells (CAR-T) for example expressing anti-CD19, anti-EpCam or anti-mesothelin);
  m) bi-specific NK cell engagers having a specificity against an activating MK receptor such as NKG2D or CD16a; and
  n) adoptive transfer of tumour specific T-cells or LAK cells.

Pharmaceutical formulations are well-known to those skilled in the art. In one embodiment, the antibody or fragment is administered intravenously. In one embodiment, the antibody or fragment is administered subcutaneously.

In an example, an antibody or fragment as disclosed herein is contained in a medical container, e.g. a vial, syringe, IV container or an injection device (such as an intraocular or intravitreal injection device). In an example, the antibody or fragment is in vitro, for example, in a sterile container.

In one embodiment, the composition is formulated in accordance with routine procedures as a pharmaceutical composition adapted for intravenous administration to human beings. Typically, compositions for intravenous administration are solutions in sterile isotonic aqueous buffer. Where necessary, the composition may also include a solubilizing agent and a local anesthetic such as lignocamne to ease pain at the site of the injection. Such compositions, however, may be administered by a route other than intravenous.

Generally, the ingredients of compositions are supplied either separately or mixed together in unit dosage form, for example, as a dry lyophilized powder or water free concentrate in a hermetically sealed container such as an ampoule or sachette indicating the quantity of active agent. Where the composition is to be administered by infusion, it can be dispensed with an infusion bottle containing sterile pharmaceutical grade water or saline. Where the composition is administered by injection, an ampoule of sterile water for injection or saline can be provided so that the ingredients may be mixed prior to administration.

In this aspect, the bispecific molecules include "bispecific antibodies" and antibody fusion proteins, including those formats and molecules described in concepts 37 to 40.

The further therapeutic agents of this concept may be delivered by any method, which methods are well-known to those skilled in the art. For example, the further therapeutic agents may be delivered orally, systemically or locally (to the tumour environment). In one embodiment, the further therapeutic agent is delivered orally. In one embodiment, the further therapeutic agent is delivered systemically (e.g. intravenously). In one embodiment, the further therapeutic agent is delivered locally to the tumour environment.

The antibodies may have any of the sequences or may be any of the antibodies described in arrangement 5, 5a or detailed in aspect 1a.

Concept 49. A pharmaceutical composition according to concept 48, or a kit comprising a pharmaceutical composition as defined in concept 48, wherein the composition is for treating and/or preventing a hPD-L1-mediated condition or disease, e.g. selected from neoplastic or non-neoplastic disease, chronic viral infections, and malignant tumours, such as melanoma, Merkel cell carcinoma, non-small cell lung cancer (squamous and non-squamous), renal cell cancer, bladder cancer, head and neck squamous cell carcinoma, mesothelioma, virally induced cancers (such as cervical cancer and nasopharyngeal cancer), soft tissue sarcomas, haematological malignancies such as Hodgkin's and non-Hodgkin's disease, diffuse large B-cell lymphoma.

Concept 50. A pharmaceutical composition according to concept 48 or concept 49 in combination with, or kit according to concept 49 comprising, a label or instructions for use to treat and/or prevent said disease or condition in a human; optionally wherein the label or instructions comprise a marketing authorisation number (e.g. an FDA or EMA authorisation number); optionally wherein the kit comprises an IV or injection device that comprises the antibody or fragment.

Concept 51. A method of modulating PD-1/PD-L1 interaction in a patient, comprising administering an effective amount of an antibody or fragment as defined in any one of concepts 1 to 40 to said patient.

In another embodiment, there is provided a method of modulating CD80/PD-L1 interaction in a patient, comprising administering an effective amount of an antibody or fragment as defined in any one of concepts 1 to 40 to said patient. In another embodiment, the antibody or fragment modulates CD80/PD-L1 interaction, but does not modulate PD-1/PD-L1 interaction. In another embodiment, the antibody or fragment blocks CD80/PD-L1 interaction, but does not block PD-1/PD-L1 interaction. In another embodiment, the antibody or fragment inhibits CD80/PD-L1 interaction, but does not inhibit PD-1/PD-L1 interaction.

Concept 52. A method of inhibiting PD-L1 activity in a patient, comprising administering an effective amount of an antibody or fragment as defined in any one of concepts 1 to 40 to said patient.

In one embodiment, the antibody or fragment blocks or inhibits PD-1 binding to PD-L1. In one embodiment, the antibody or fragment blocks or inhibits CD80 binding to PD-1.

Concept 53. A method of treating a proliferative disease in an animal (e.g. a human), comprising administering an effective amount of an antibody or fragment as defined in any one of concepts 1 to 40 to said patient.

Proliferative diseases may be any as described elsewhere herein.

Concept 54. A method of detecting PD-L1 expression in a sample, comprising contacting the sample with an antibody or fragment as defined in any one of concepts 1 to 40.

Concept 55. A method comprising contacting a biological sample with an antibody or fragment as defined in any one of concepts 1 to 40 to form a complex with PD-L1 present in the sample and measuring the presence, absence or level of the complex in the biological sample.

Concept 56. The method according to concept 55, wherein the presence, absence and/or level of PD-L1 expression is detected prior to treatment and a high level of surface expressed PD-L1 is indicative of successful treatment.

Concept 57. The method according to concept 55, wherein the presence, absence and/or level of PD-L1 expression is detected during treatment as an early response biomarker.

Concept 58. The method according to concept 55 or concept 57, wherein the presence, absence and/or level of PD-L1 expression is detected during or after treatment to help determine one or more of: whether treatment has been successful, whether treatment should continue, and/or whether treatment should be modified.

Concept 59. The method according to any one of concepts 55 to 58, wherein therapy comprises treatment with an anti-PD-L1 antibody, optionally as defined in any one of concepts 1 to 40.

Concept 60. A method for monitoring therapy efficacy, the method comprising detecting expression of surface expressed PD-L1 in a patient prior to therapy, and during or after therapy, wherein an antibody or fragment as defined in any one of concepts 1 to 40 is used to detect expression of surface expressed PD-1.

Concept 61. The method according to concept 60, wherein surface expressed PD-L1 expression is detected in vivo.

Concept 62. The method according to concept 60, wherein surface expressed PD-L1 expression is detected in a tissue sample in vitro.

Concept 63. A method for identifying binding partners for PD-L1, the method comprising immunoprecipitating an intact protein complex comprising PD-L1 using an antibody or fragment as defined in any one of concepts 1 to 40.

Concept 64. A method of diagnosing a disease in a human subject associated with altered PD-L1 expression comprising the steps of contacting a biological sample from the human subject with an antibody as defined in concepts 1 to 40 to form a complex between the antibody and PD-L1 present in the sample; and detecting the amount of the complex.

Concept 65. A nucleic acid that encodes the CDRH3 of an antibody or fragment as defined in any one of concepts 1 to 40.

Concept 65a. There is also provided a nucleic acid that encodes the CDRH2 of an antibody or fragment as defined in any one of concepts 1 to 40.

Concept 65b. There is also provided a nucleic acid that encodes the CDRH1 of an antibody or fragment as defined in any one of concepts 1 to 40.

Concept 65c. There is also provided a nucleic acid that encodes the CDRL1 of an antibody or fragment as defined in any one of concepts 1 to 40.

Concept 65d. There is also provided a nucleic acid that encodes the CDRL2 of an antibody or fragment as defined in any one of concepts 1 to 40.

Concept 65e. There is also provided a nucleic acid that encodes the CDRL3 of an antibody or fragment as defined in any one of concepts 1 to 40.

In one embodiment, the nucleic acid is an isolated and purified nucleic acid.

Concept 66. A nucleic acid that encodes a $V_H$ domain and/or a $V_L$ domain of an antibody or fragment as defined in any one of concepts 1 to 40.

The $V_H$ and $V_L$ domain nucleic acid sequences of the invention are provided in the sequence listing. In one embodiment, the nucleic acid sequence is at least 70% identical to the specified Seq ID No. In one embodiment, the nucleic acid sequence is at least 75% identical to the specified Seq ID No. In one embodiment, the nucleic acid sequence is at least 95% identical to the specified Seq ID No. In one embodiment, the nucleic acid sequence is at least 96% identical to the specified Seq ID No. In one embodiment, the nucleic acid sequence is at least 97% identical to the specified Seq ID No. In one embodiment, the nucleic acid sequence is at least 98% identical to the specified Seq ID No. In one embodiment, the nucleic acid sequence is at least 99% identical to the specified Seq ID No. In one embodiment, the nucleic acid sequence is at least 99.5% identical to the specified Seq ID No.

Concept 67. The nucleic acid according to concept 66 comprising a nucleotide sequence that is at least 80% identical to the sequence of SEQ ID NO:36 and/or SEQ ID NO:46.

Concept 67a. A nucleic acid according to concept 66 comprising a nucleotide sequence that is at least 80% identical to the sequence of SEQ ID NO:16 and/or SEQ ID NO:26.

Concept 67b. A nucleic acid according to concept 66 comprising a nucleotide sequence that is at least 80% identical to the sequence of SEQ ID NO:61 and/or SEQ ID NO:71.

Concept 67c. A nucleic acid according to concept 66 comprising a nucleotide sequence that is at least 80% identical to the sequence of SEQ ID NO:81 and/or SEQ ID NO:91.

Concept 67d. A nucleic acid according to concept 66 comprising a nucleotide sequence that is at least 80% identical to the sequence of SEQ ID NO:101 and/or SEQ ID NO:111.

Concept 67e. A nucleic acid according to concept 66 comprising a nucleotide sequence that is at least 80% identical to the sequence of SEQ ID NO:121 and/or SEQ ID NO:131.

Concept 67f. A nucleic acid according to concept 66 comprising a nucleotide sequence that is at least 80% identical to the sequence of SEQ ID NO:161 and/or SEQ ID NO:171.

Concept 67g. A nucleic acid according to concept 66 comprising a nucleotide sequence that is at least 80% identical to the sequence of SEQ ID NO:181 and/or SEQ ID NO:191.

Concept 67h. A nucleic acid according to concept 66 comprising a nucleotide sequence that is at least 80% identical to the sequence of SEQ ID NO:141 and/or SEQ ID NO:151.

Concept 67i. A nucleic acid according to concept 66 comprising a nucleotide sequence that is at least 80% identical to the sequence of SEQ ID NO:247 and/or SEQ ID NO:257.

Concept 67j. A nucleic acid according to concept 66 comprising a nucleotide sequence that is at least 80% identical to the sequence of SEQ ID NO:267 and/or SEQ ID NO:277.

Concept 67k. A nucleic acid according to concept 66 comprising a nucleotide sequence that is at least 80% identical to the sequence of SEQ ID NO:287 and/or SEQ ID NO:297.

Concept 67l. A nucleic acid according to concept 66 comprising a nucleotide sequence that is at least 80% identical to the sequence of SEQ ID NO:352 and/or SEQ ID NO:362.

In one embodiment, the nucleic acid sequence is at least 70% identical to the specified Seq ID No. In one embodiment, the nucleic acid sequence is at least 75% identical to the specified Seq ID No. In one embodiment, the nucleic acid sequence is at least 95% identical to the specified Seq ID No. In one embodiment, the nucleic acid sequence is at least 96% identical to the specified Seq ID No. In one embodiment, the nucleic acid sequence is at least 97% identical to the specified Seq ID No. In one embodiment, the nucleic acid sequence is at least 98% identical to the specified Seq ID No. In one embodiment, the nucleic acid sequence is at least 99% identical to the specified Seq ID No. In one embodiment, the nucleic acid sequence is at least 99.5% identical to the specified Seq ID No.

Concept 68. A nucleic acid that encodes a heavy chain or a light chain of an antibody as defined in any one of concepts 1 to 40.

Concept 69. A vector comprising the nucleic acid of any one of concepts 65 to 68; optionally wherein the vector is a CHO or HEK293 vector.

Concept 70. A host comprising the nucleic acid of any one of concepts 65 to 68 or the vector of concept 69.

3. Immunocytokines

The inventors have described immunocytokines which comprise an antibody which binds to an immune checkpoint inhibitor, such as PD-L1 fused to either the N-terminus or C-terminus of the heavy chain or the light chain (for example, the C-terminus of the heavy or light chain, and in particular the light chain). The immunocytokines comprise a cytokine molecule, which may be IL-2 or a variant thereof (including variant having a 1 to 10 amino acid deletion at the N-terminus). The antibodies as described hereinabove may be used in any immunocytokine described herein.

Without being bound by theory, immunocytokines of the invention may provide one or more of the following advantageous properties:

- synergistic activity (by virtue of the therapeutic activity of antibody Fab portion in combination with the cytokine)
- improved tumour targeting
- ability to retain effector functions such as CDC, ADCC and/or ADCP
- reduced off-target effects
- reduced toxicity (e.g. compared to free cytokine or cytokine when fused to the heavy chain of an immunocytokine)
- reduced immunogenicity
- lower dose/frequency of dosing, in particular due to improved half life of light chain cytokine fusions as compared to heavy chain fusion equivalents Specificity for blocking only one of the ligands of PD-L1 (e.g. blocks CD80/PD-L1 interaction, but not PD-1/PD-L1 interaction)
Solubility
Stability
Ease of formulation
Frequency of dosing and/or route of administration
Manufacturability (e.g. expression, ease of purification, isoforms)

1D05 ICK comprises a heavy chain amino acid sequence of Seq ID No:299, and a light chain amino acid sequence of Seq ID No:300. The light chain comprises a $V_L$ domain comprising the CDRs and $V_L$ sequence of antibody 1D05 described hereinabove, fused at the heavy chain to full length, wild-type, human IL-2 cytokine. It does not contain a linker peptide. The heavy chain comprises a $V_H$ domain comprising the CDRs and $V_H$ sequence of antibody 1D05 described hereinabove, fused to a disabled IgG constant region (Seq ID No:205).

1D05 D5-9 ICK comprises a heavy chain comprising a $V_H$ region amino acid sequence of Seq ID No:33 (comprising the CDRs of 1D05 as described hereinabove) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D5-9 (Seq ID No:303), which is directly fused to amino acids 21 to 133 of hIL-2 (Seq ID No:324).

1D05 D1-9 ICK comprises a heavy chain comprising a $V_H$ region amino acid sequence of Seq ID No:33 (comprising the CDRs of 1D05 as described hereinabove) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D1-9 (Seq ID No:304), which is directly fused to amino acids 21 to 133 of hIL-2 (Seq ID No:324).

1D05 D5-7 ICK comprises a heavy chain comprising a $V_H$ region amino acid sequence of Seq ID No:33 (comprising the CDRs of 1D05 as described hereinabove) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D5-7 (Seq ID No:305), which is directly fused to amino acids 21 to 133 of hIL-2 (Seq ID No:324).

1D05 D1 ICK comprises a heavy chain comprising a $V_H$ region amino acid sequence of Seq ID No:33 (comprising the CDRs of 1D05 as described hereinabove) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D1 (Seq ID No:306), which is directly fused to amino acids 21 to 133 of hIL-2 (Seq ID No:324).

1D05 D1-2 ICK comprises a heavy chain comprising a $V_H$ region amino acid sequence of Seq ID No:33 (comprising the CDRs of 1D05 as described hereinabove) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D1-2 (Seq ID No:307), which is directly fused to amino acids 21 to 133 of hIL-2 (Seq ID No:324).

1D05 D1-3 ICK comprises a heavy chain comprising a $V_H$ region amino acid sequence of Seq ID No:33 (comprising the CDRs of 1D05 as described hereinabove) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D1-3 (Seq ID No:308), which is directly fused to amino acids 21 to 133 of hIL-2 (Seq ID No:324).

1D05 D1-4 ICK comprises a heavy chain comprising a $V_H$ region amino acid sequence of Seq ID No:33 (comprising the CDRs of 1D05 as described hereinabove) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D1-4 (Seq ID No:309), which is directly fused to amino acids 21 to 133 of hIL-2 (Seq ID No:324).

1D05 D1-5 ICK comprises a heavy chain comprising a $V_H$ region amino acid sequence of Seq ID No:33 (comprising the CDRs of 1D05 as described hereinabove) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D1-5 (Seq ID No:310), which is directly fused to amino acids 21 to 133 of hIL-2 (Seq ID No:324).

1D05 D1-6 ICK comprises a heavy chain comprising a $V_H$ region amino acid sequence of Seq ID No:33 (comprising the CDRs of 1D05 as described hereinabove) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D1-6 (Seq ID No:311), which is directly fused to amino acids 21 to 133 of hIL-2 (Seq ID No:324).

1D05 D1-7 ICK comprises a heavy chain comprising a $V_H$ region amino acid sequence of Seq ID No:33 (comprising the CDRs of 1D05 as described hereinabove) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D1-7 (Seq ID No:312), which is directly fused to amino acids 21 to 133 of hIL-2 (Seq ID No:324).

1D05 D1-8 ICK comprises a heavy chain comprising a $V_H$ region amino acid sequence of Seq ID No:33 (comprising the CDRs of 1D05 as described hereinabove) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D1-8 (Seq ID No:313), which is directly fused to amino acids 21 to 133 of hIL-2 (Seq ID No:324).

1D05 D9 ICK comprises a heavy chain comprising a $V_H$ region amino acid sequence of Seq ID No:33 (comprising the CDRs of 1D05 as described hereinabove) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D9 (Seq ID No:314), which is directly fused to amino acids 21 to 133 of hIL-2 (Seq ID No:324).

1D05 D9-8 ICK comprises a heavy chain comprising a $V_H$ region amino acid sequence of Seq ID No:33 (comprising the CDRs of 1D05 as described hereinabove) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D9-8 (Seq ID No:315), which is directly fused to amino acids 21 to 133 of hIL-2 (Seq ID No:324).

1D05 D9-7 ICK comprises a heavy chain comprising a $V_H$ region amino acid sequence of Seq ID No:33 (comprising the CDRs of 1D05 as described hereinabove) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D9-7 (Seq ID No:316), which is directly fused to amino acids 21 to 133 of hIL-2 (Seq ID No:324).

1D05 D9-6 ICK comprises a heavy chain comprising a $V_H$ region amino acid sequence of Seq ID No:33 (comprising the CDRs of 1D05 as described hereinabove) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D9-6 (Seq ID No:317), which is directly fused to amino acids 21 to 133 of hIL-2 (Seq ID No:324).

1D05 D9-4 ICK comprises a heavy chain comprising a $V_H$ region amino acid sequence of Seq ID No:33 (comprising the CDRs of 1D05 as described hereinabove) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D9-4 (Seq ID No:318), which is directly fused to amino acids 21 to 133 of hIL-2 (Seq ID No:324).

1D05 D9-3 ICK comprises a heavy chain comprising a $V_H$ region amino acid sequence of Seq ID No:33 (comprising the CDRs of 1D05 as described hereinabove) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D9-3 (Seq ID No:319), which is directly fused to amino acids 21 to 133 of hIL-2 (Seq ID No:324).

1D05 D9-2 ICK comprises a heavy chain comprising a $V_H$ region amino acid sequence of Seq ID No:33 (comprising the CDRs of 1D05 as described hereinabove) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D9-2 (Seq ID No:320), which is directly fused to amino acids 21 to 133 of hIL-2 (Seq ID No:324).

1D05 D2-6 ICK comprises a heavy chain comprising a $V_H$ region amino acid sequence of Seq ID No:33 (comprising the CDRs of 1D05 as described hereinabove) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D2-6 (Seq ID No:321), which is directly fused to amino acids 21 to 133 of hIL-2 (Seq ID No:324).

1D05 D3-7 ICK comprises a heavy chain comprising a $V_H$ region amino acid sequence of Seq ID No:33 (comprising the CDRs of 1D05 as described hereinabove) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D3-7 (Seq ID No:322), which is directly fused to amino acids 21 to 133 of hIL-2 (Seq ID No:324).

1D05 D4-8 ICK comprises a heavy chain comprising a $V_H$ region amino acid sequence of Seq ID No:33 (comprising the CDRs of 1D05 as described hereinabove) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D4-8 (Seq ID No:323), which is directly fused to amino acids 21 to 133 of hIL-2 (Seq ID No:324).

In any of the ICK constructs above, the IL-2 binding portion may be a variant IL-2, in particular an IL-2 having an R38A mutation (as described in amino acids 21-133 of the variant IL-2 described as SEQ ID NO:517) or an R38Q mutation (as described in amino acids 21-133 of the variant IL-2 described as SEQ ID NO:518).

In any of the ICK constructs above, the $V_H$ region of the 1D05 antibody may be exchanged for the $V_H$ region of mutated 1D05—Heavy Chain mutant 1 (Seq ID No:47), mutated 1D05—Heavy Chain mutant 2 (Seq ID No:48), mutated 1D05—Heavy Chain mutant 3 (Seq ID No:49) or mutated 1D05—Heavy Chain mutant 4 (Seq ID No:342). A preferred mutated heavy chain $V_H$ region of 1D05 is mutated 1D05—Heavy Chain mutant 4 (Seq ID No:342).

Thus, certain ICK constructs comprise:

Mutated 1D05—Heavy Chain mutant 4 D5-9 ICK, which comprises a heavy chain comprising a $V_H$ region amino acid sequence of Seq ID No:342 (comprising the CDRs of mutated 1D05—Heavy Chain mutant 4 as described herein) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D5-9 (Seq ID No:303), which is directly fused to amino acids 21 to 133 of hIL-2 (Seq ID No:324).

Mutated 1D05—Heavy Chain mutant 4 D1-9 ICK, which comprises a heavy chain comprising a $V_H$ region amino acid sequence of Seq ID No:342 (comprising the CDRs of mutated 1D05—Heavy Chain mutant 4 as described herein) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D1-9 (Seq ID No:304), which is directly fused to amino acids 21 to 133 of hIL-2 (Seq ID No:324).

Mutated 1D05—Heavy Chain mutant 4 D1-8 ICK, which comprises a heavy chain comprising a $V_H$ region amino acid sequence of Seq ID No:342 (comprising the CDRs of mutated 1D05—Heavy Chain mutant 4 as described herein) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D1-8 (Seq ID No:313), which is directly fused to amino acids 21 to 133 of hIL-2 (Seq ID No:324).

Mutated 1D05—Heavy Chain mutant 4 D9-7 ICK, which comprises a heavy chain comprising a $V_H$ region amino acid sequence of Seq ID No:342 (comprising the CDRs of mutated 1D05—Heavy Chain mutant 4 as described herein) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D9-7 (Seq ID No:316), which is directly fused to amino acids 21 to 133 of hIL-2 (Seq ID No:324).

Mutated 1D05—Heavy Chain mutant 4 D9-2 ICK, which comprises a heavy chain comprising a $V_H$ region amino acid sequence of Seq ID No:342 (comprising the CDRs of mutated 1D05—Heavy Chain mutant 4 as described herein) fused to a disabled IgG1 constant region with an amino acid sequence of Seq ID No:205. The light chain comprises a $V_L$ amino acid sequence of Seq ID No:43 (comprising the CDRs of 1D05 as described hereinabove) directly fused at the C-terminus to IL-2 D9-2 (Seq ID No:320), which is directly fused to amino acids 21 to 133 of hIL-2 (Seq ID No:324).

In any of the ICK constructs above, the $V_L$ region of the 1D05 antibody may be exchanged for the $V_L$ region of mutated 1D05—Light Chain mutant 1 (Seq ID No:50), mutated 1D05—Light Chain mutant 2 (Seq ID No:51) or mutated 1D05—Light Chain mutant 3 (Seq ID No:298).

In any of the ICK constructs above, both the $V_H$ and $V_L$ region of the 1D05 antibody may be exchanged for both the $V_H$ and $V_L$ regions of any of the other antibodies described herein, i.e. 84G09, 411B08, 411C04, 411D07, 385F01, 413D08, 386H03, 389A03, 413G05, 413F09 and 414B06.

In any of the ICK constructs above, the heavy chain constant region of Seq ID No:205 may be exchanged for any of the heavy chain constant regions of Seq ID Nos:193, 195, 197, 199, 203, 205, 340, 524, 526, 528, 530, 532 or 534.

Immunocytokines may be described in the following sentences or aspects. Unless otherwise apparent, the features of any of the concepts described hereinabove apply mutatis mutandis to any of the aspects hereinbelow.

Aspect 1. An immunocytokine comprising an immunoglobulin heavy chain and an immunoglobulin light chain, wherein the heavy chain comprises in N- to C-terminal direction:
a) A $V_H$ domain comprising CDRH1, CDRH2 and CDRH3; and
b) A heavy chain constant region;
and wherein the light chain comprises in N- to C-terminal direction:
c) A $V_L$ domain comprising CDRL1, CDRL2 and CDRL3;
d) A light chain constant region, ($C_L$);
e) Optionally, a linker, (L); and
f) An IL-2 cytokine;
wherein the $V_H$ domain and $V_L$ domain are comprised by an antigen-binding site that specifically binds to hPD-L1 as defined by Seq ID No:1, and competes for binding to said hPD-L1 with the antibody 1D05; and
wherein the immunocytokine comprises a $V_H$ domain which comprises a CDRH3 comprising the motif $X_1GSGX_2YGX_3X_4FD$ (SEQ ID NO: 753), wherein $X_1$, $X_2$ and $X_3$ are independently any amino acid, and $X_4$ is either present or absent, and if present, may be any amino acid.

In the aspects described herein, CDR sequences may be determined according to any method known to those skilled in the art, such as using the Kabat method, the IMGT method or the Chothia method, each of which are described in more detail herein. In one embodiment, the CDR regions are human CDR regions.

In addition to the CDR regions, the $V_H$ and/or $V_L$ domains may further comprise framework regions, such as FW1, FW2 and FW3. The $V_H$ and/or $V_L$ domains may be of any origin described herein, and may be for example, fully human, humanised, murine or camelid. In one embodiment, the $V_H$ and/or $V_L$ domains are human $V_H$ and/or $V_L$ domains. CDRs may be of a non-human origin (e.g. mouse origin) and be grafted onto human framework regions. In another embodiment, the CDRs are synthetic.

In another embodiment, $V_H$ regions may be selected from the group consisting of an antibody variable domain (e.g. a $V_L$ or a $V_H$, an antibody single variable domain (domain antibody or dAb), a camelid $V_{HH}$ antibody single variable domain, a shark immunoglobulin single variable domain (NARV), a Nanobody™ or a camelised $V_H$ single variable domain); a T-cell receptor binding domain; an immunoglobulin superfamily domain; an agnathan variable lymphocyte receptor; a fibronectin domain (e.g. an Adnectin™); an antibody constant domain (e.g. a $CH_3$ domain, e.g. a $CH_2$ and/or $CH_3$ of an Fcab™) wherein the constant domain is not a functional $CH_1$ domain; an scFv; an (scFv)$_2$; an sc-diabody; an scFab; a centyrin and an epitope binding domain derived from a scaffold selected from CTLA-4 (Evibody™); a lipocalin domain; Protein A such as Z-domain of Protein A (e.g. an Affibody™ or SpA); an A-domain (e.g. an Avimer™ or Maxibody™); a heat shock protein (such as and epitope binding domain derived from GroEI and GroES); a transferrin domain (e.g. a trans-body); ankyrin repeat protein (e.g. a DARPin™); peptide aptamer; C-type lectin domain (e.g. Tetranectin™); human γ-crystallin or human ubiquitin (an affilin); a PDZ domain; scorpion toxin; and a kunitz type domain of a human protease inhibitor.

The constant region comprises at least two heavy chain constant region domains selected from $CH_1$, $CH_2$, $CH_3$ and $CH_4$. In one embodiment, the constant region comprises (or consists of) a $CH_1$ domain and a $CH_2$ domain. In one embodiment, the constant region comprises (or consists of) a $CH_1$ domain, a hinge region and a $CH_2$ domain. In one embodiment, the constant region comprises (or consists of) a $CH_1$ domain and a $CH_3$ domain, and optionally a hinge region. In one embodiment, the constant region comprises (or consists of) a $CH_1$ domain and a $CH_4$ domain, and optionally a hinge region. In one embodiment, the constant region comprises (or consists of) a $CH_1$ domain, a $CH_2$ domain and a $CH_3$ domain, and optionally a hinge region. In one embodiment, the constant region comprises (or consists of) a $CH_1$ domain, a $CH_2$ domain and a $CH_4$ domain, and optionally a hinge region. In one embodiment, the constant region comprises (or consists of) a $CH_1$ domain, a $CH_3$ domain and a $CH_4$ domain, and optionally a hinge region. In one embodiment, the constant region comprises (or consists of) a full constant region.

The constant region may be of any isotype described herein, e.g. IgA, IgD, IgE, IgG, and IgM. In one embodiment, the constant region is of any origin described herein, and may be for example, human, murine or camelid. In one embodiment, the constant region is a (full) human constant region. In one embodiment, the constant region is a human IgG constant region. In one embodiment, the constant region is a (full) human IgG1 constant region. In one embodiment, the constant region is an effector null (full) human IgG1 constant region. In one embodiment, the constant region has CDC and/or ADCC and/or ADCP activity. In one embodiment, the constant region is engineered to enhance the CDC and/or ADCC and/or ADCP activity. The constant region may be any of the constant regions described in concepts 30 to 32 hereinabove.

The light chain constant region may be a kappa or lambda light chain constant region. The light chain constant region may be as described in concept 28 hereinabove.

An IL-2 cytokine is a cytokine molecule which confers IL-2 activity on one or both of the intermediate affinity IL-2 Receptor (αβ) and the high affinity IL-2 receptor (αβγ). An IL-2 cytokine includes variant IL-2 cytokines. An IL-2 cytokine may be of human origin or of non-human origin, for example of a non-human mammal, including, but not limited to, primates (e.g. monkeys such a rhesus macaque or cynomolgus), rodents (such as mice, rats and guinea pigs) farm animals, (such as cattle, sheep, pigs, goats, horses, chickens, turkeys, ducks and geese), and domestic mammals (such as dogs and cats). In one embodiment, an IL-2 cytokine is a human IL-2 cytokine.

As used herein, a "variant IL-2 cytokine" is a cytokine having up to 10 amino acids deleted from the N terminal sequence, in combination with up to 5 amino acid substitutions, deletions or additions elsewhere in the IL-2 cytokine. In one embodiment, the variant IL-2 cytokine comprises (or consists of) up to 10 (e.g. 1, 2, 3, 4, 5, 6, 7, 8, 9 or 10) amino acid deletions from the N-terminal sequence (e.g. within the first 20, or first 15, or first 10 amino acids of the wild-type IL-2 sequence in question), in combination with up to 5 (e.g. 1, 2, 3, 4 or 5) amino acid substitutions elsewhere in the IL-2 cytokine. In one embodiment, the variant IL-2 cytokine comprises (or consists of) up to 10 (e.g. 1, 2, 3, 4, 5, 6, 7, 8, 9 or 10) amino acid deletions from the N-terminal sequence (e.g. within the first 15 amino acids of the wild-type IL-2 sequence in question), in combination with up to 5 (e.g. 1, 2, 3, 4 or 5) amino acid substitutions elsewhere in the IL-2 cytokine. In one embodiment, the variant IL-2 cytokine comprises (or consists of) up to 10 (e.g. 1, 2, 3, 4, 5, 6, 7, 8, 9 or 10) amino acid deletions from the N-terminal sequence (e.g. within the first 10 amino acids of the wild-type IL-2 sequence in question), in combination with up to 5 (e.g. 1, 2, 3, 4 or 5) amino acid substitutions elsewhere in the IL-2 cytokine. In one embodiment, the variant IL-2 cytokine comprises (or consists of) up to 10 (e.g. 1, 2, 3, 4, 5, 6, 7, 8, 9 or 10) amino acid deletions from the N-terminal sequence (e.g. within the first 20, or first 15, or first 10 amino acids of the wild-type IL-2 sequence in question), in combination with up to 4 (e.g. 1, 2, 3 or 4) amino acid substitutions elsewhere in the IL-2 cytokine. In one embodiment, the variant IL-2 cytokine comprises (or consists of) up to 10 (e.g. 1, 2, 3, 4, 5, 6, 7, 8, 9 or 10) amino acid deletions from the N-terminal sequence (e.g. within the first 20, or first 15, or first 10 amino acids of the wild-type IL-2 sequence in question), in combination with up to 3 (e.g. 1, 2 or 3) amino acid substitutions elsewhere in the IL-2 cytokine. In one embodiment, the variant IL-2 cytokine comprises (or consists of) up to 10 (e.g. 1, 2, 3, 4, 5, 6, 7, 8, 9 or 10) amino acid deletions from the N-terminal sequence (e.g. within the first 20, or first 15, or first 10 amino acids of the wild-type IL-2 sequence in question), in combination with up to 2 (e.g. 1 or 2) amino acid substitutions elsewhere in the IL-2 cytokine. In one embodiment, the variant IL-2 cytokine comprises (or consists of) up to 10 (e.g. 1, 2, 3, 4, 5, 6, 7, 8, 9 or 10) amino acid deletions from the N-terminal sequence (e.g. within the first 20, or first 15, or first 10 amino acids of the wild-type IL-2 sequence in question), in combination with 1 amino acid substitution elsewhere in the IL-2 cytokine.

In one embodiment, the variant IL-2 cytokine comprises (or consists of) up to 9 (e.g. 1, 2, 3, 4, 5, 6, 7, 8 or 9) amino acid deletions from the N-terminal sequence (e.g. within the first 20, or first 15, or first 10 amino acids of the wild-type IL-2 sequence in question), in combination with up to 4 (e.g. 1, 2, 3 or 4) amino acid substitutions elsewhere in the IL-2 cytokine. In one embodiment, the variant IL-2 cytokine comprises (or consists of) up to 9 (e.g. 1, 2, 3, 4, 5, 6, 7, 8 or 9) amino acid deletions from the N-terminal sequence (e.g. within the first 20, or first 15, or first 10 amino acids of the wild-type IL-2 sequence in question), in combination with up to 3 (e.g. 1, 2 or 3) amino acid substitutions elsewhere in the IL-2 cytokine. In one embodiment, the variant IL-2 cytokine comprises (or consists of) up to 9 (e.g. 1, 2, 3, 4, 5, 6, 7, 8 or 9) amino acid deletions from the N-terminal sequence (e.g. within the first 20, or first 15, or first 10 amino acids of the wild-type IL-2 sequence in question), in combination with up to 2 (e.g. 1 or 2) amino acid substitutions elsewhere in the IL-2 cytokine. In one embodiment, the variant IL-2 cytokine comprises (or consists of) up to 9 (e.g. 1, 2, 3, 4, 5, 6, 7, 8 or 9) amino acid deletions from the N-terminal sequence (e.g. within the first 20, or first 15, or first 10 amino acids of the wild-type IL-2 sequence in question), in combination with one amino acid substitution elsewhere in the IL-2 cytokine.

In one embodiment, the variant IL-2 cytokine comprises (or consists of) up to 8 (e.g. 1, 2, 3, 4, 5, 6, 7 or 8) amino acid deletions from the N-terminal sequence (e.g. within the first 20, or first 15, or first 10 amino acids of the wild-type IL-2 sequence in question), in combination with up to 4 (e.g. 1, 2, 3 or 4) amino acid substitutions elsewhere in the IL-2 cytokine. In one embodiment, the variant IL-2 cytokine comprises (or consists of) up to 8 (e.g. 1, 2, 3, 4, 5, 6, 7 or 8) amino acid deletions from the N-terminal sequence (e.g. within the first 20, or first 15, or first 10 amino acids of the wild-type IL-2 sequence in question), in combination with up to 3 (e.g. 1, 2 or 3) amino acid substitutions elsewhere in the IL-2 cytokine. In one embodiment, the variant IL-2 cytokine comprises (or consists of) up to 8 (e.g. 1, 2, 3, 4, 5, 6, 7 or 8) amino acid deletions from the N-terminal sequence (e.g. within the first 20, or first 15, or first 10 amino acids of the wild-type IL-2 sequence in question), in combination with up to 2 (e.g. 1 or 2) amino acid substitutions elsewhere in the IL-2 cytokine. In one embodiment, the variant IL-2 cytokine comprises (or consists of) up to 8 (e.g. 1, 2, 3, 4, 5, 6, 7 or 8) amino acid deletions from the N-terminal sequence (e.g. within the first 20, or first 15, or first 10 amino acids of the wild-type IL-2 sequence in question), in combination with one amino acid substitution elsewhere in the IL-2 cytokine.

In one embodiment, the variant IL-2 cytokine comprises (or consists of) up to 7 (e.g. 1, 2, 3, 4, 5, 6 or 7) amino acid deletions from the N-terminal sequence (e.g. within the first 20, or first 15, or first 10 amino acids of the wild-type IL-2 sequence in question), in combination with up to 4 (e.g. 1, 2, 3 or 4) amino acid substitutions elsewhere in the IL-2 cytokine. In one embodiment, the variant IL-2 cytokine comprises (or consists of) up to 7 (e.g. 1, 2, 3, 4, 5, 6 or 7) amino acid deletions from the N-terminal sequence (e.g. within the first 20, or first 15, or first 10 amino acids of the wild-type IL-2 sequence in question), in combination with up to 3 (e.g. 1, 2 or 3) amino acid substitutions elsewhere in the IL-2 cytokine. In one embodiment, the variant IL-2 cytokine comprises (or consists of) up to 7 (e.g. 1, 2, 3, 4, 5, 6 or 7) amino acid deletions from the N-terminal sequence (e.g. within the first 20, or first 15, or first 10 amino acids of the wild-type IL-2 sequence in question), in combination with up to 2 (e.g. 1 or 2) amino acid substitutions elsewhere in the IL-2 cytokine. In one embodiment, the variant IL-2 cytokine comprises (or consists of) up to 7 (e.g. 1, 2, 3, 4, 5, 6 or 7) amino acid deletions from the N-terminal sequence (e.g. within the first 20, or first 15, or first 10 amino acids of the wild-type IL-2 sequence in question), in combination with one amino acid substitution elsewhere in the IL-2 cytokine.

In one embodiment, the variant IL-2 cytokine comprises (or consists of) up to 6 (e.g. 1, 2, 3, 4, 5 or 6) amino acid deletions from the N-terminal sequence (e.g. within the first 20, or first 15, or first 10 amino acids of the wild-type IL-2 sequence in question), in combination with up to 4 (e.g. 1, 2, 3 or 4) amino acid substitutions elsewhere in the IL-2 cytokine. In one embodiment, the variant IL-2 cytokine comprises (or consists of) up to 6 (e.g. 1, 2, 3, 4, 5 or 6) amino acid deletions from the N-terminal sequence (e.g. within the first 20, or first 15, or first 10 amino acids of the wild-type IL-2 sequence in question), in combination with up to 3 (e.g. 1, 2 or 3) amino acid substitutions elsewhere in the IL-2 cytokine. In one embodiment, the variant IL-2 cytokine comprises (or consists of) up to 6 (e.g. 1, 2, 3, 4, 5 or 6) amino acid deletions from the N-terminal sequence (e.g. within the first 20, or first 15, or first 10 amino acids of the wild-type IL-2 sequence in question), in combination with up to 2 (e.g. 1 or 2) amino acid substitutions elsewhere in the IL-2 cytokine.

In one embodiment, the variant IL-2 cytokine comprises (or consists of) up to 5 (e.g. 1, 2, 3, 4 or 5) amino acid deletions from the N-terminal sequence (e.g. within the first 20, or first 15, or first 10 amino acids of the wild-type IL-2 sequence in question), in combination with up to 4 (e.g. 1, 2, 3 or 4) amino acid substitutions elsewhere in the IL-2 cytokine. In one embodiment, the variant IL-2 cytokine comprises (or consists of) up to 5 (e.g. 1, 2, 3, 4 or 5) amino acid deletions from the N-terminal sequence (e.g. within the first 20, or first 15, or first 10 amino acids of the wild-type IL-2 sequence in question), in combination with up to 4 (e.g. 1, 2, 3 or 4) amino acid substitutions elsewhere in the IL-2 cytokine. In one embodiment, the variant IL-2 cytokine comprises (or consists of) up to 5 (e.g. 1, 2, 3, 4 or 5) amino acid deletions from the N-terminal sequence (e.g. within the first 20, or first 15, or first 10 amino acids of the wild-type IL-2 sequence in question), in combination with up to 4 (e.g. 1, 2, 3 or 4) amino acid substitutions elsewhere in the IL-2 cytokine. In one embodiment, the variant IL-2 cytokine comprises (or consists of) up to 6 (e.g. 1, 2, 3, 4, 5 or 6) amino acid deletions from the N-terminal sequence (e.g. within the first 20, or first 15, or first 10 amino acids of the wild-type IL-2 sequence in question), in combination with one amino acid substitution elsewhere in the IL-2 cytokine.

In one embodiment, the variant IL-2 cytokine comprises (or consists of) up to 4 (e.g. 1, 2, 3 or 4) amino acid deletions from the N-terminal sequence (e.g. within the first 20, or first 15, or first 10 amino acids of the wild-type IL-2 sequence in question), in combination with up to 4 (e.g. 1, 2, 3 or 4) amino acid substitutions elsewhere in the IL-2 cytokine. In one embodiment, the variant IL-2 cytokine comprises (or consists of) up to 4 (e.g. 1, 2, 3 or 4) amino acid deletions from the N-terminal sequence (e.g. within the first 20, or first 15, or first 10 amino acids of the wild-type IL-2 sequence in question), in combination with up to 3 (e.g. 1, 2 or 3) amino acid substitutions elsewhere in the IL-2 cytokine. In one embodiment, the variant IL-2 cytokine comprises (or consists of) up to 4 (e.g. 1, 2, 3 or 4) amino acid deletions from the N-terminal sequence (e.g. within the first 20, or first 15, or first 10 amino acids of the wild-type IL-2 sequence in question), in combination with up to 2 (e.g. 1 or 2) amino acid substitutions elsewhere in the IL-2 cytokine. In one embodiment, the variant IL-2 cytokine comprises (or consists of) up to 4 (e.g. 1, 2, 3 or 4) amino acid deletions from the N-terminal sequence (e.g. within the first 20, or first 15, or first 10 amino acids of the wild-type IL-2 sequence in question), in combination with one amino acid substitution elsewhere in the IL-2 cytokine.

In one embodiment, the variant IL-2 cytokine comprises (or consists of) up to 3 (e.g. 1, 2 or 3) amino acid deletions from the N-terminal sequence (e.g. within the first 20, or first 15, or first 10 amino acids of the wild-type IL-2 sequence in question), in combination with up to 4 (e.g. 1, 2, 3 or 4) amino acid substitutions elsewhere in the IL-2 cytokine. In one embodiment, the variant IL-2 cytokine comprises (or consists of) up to 3 (e.g. 1, 2 or 3) amino acid deletions from the N-terminal sequence (e.g. within the first 20, or first 15, or first 10 amino acids of the wild-type IL-2 sequence in question), in combination with up to 3 (e.g. 1, 2 or 3) amino acid substitutions elsewhere in the IL-2 cytokine. In one embodiment, the variant IL-2 cytokine comprises (or consists of) up to 3 (e.g. 1, 2 or 3) amino acid deletions from the N-terminal sequence (e.g. within the first 20, or first 15, or first 10 amino acids of the wild-type IL-2 sequence in question), in combination with up to 2 (e.g. 1 or 2) amino acid substitutions elsewhere in the IL-2 cytokine. In one embodiment, the variant IL-2 cytokine comprises (or consists of) up to 3 (e.g. 1, 2 or 3) amino acid deletions from the N-terminal sequence (e.g. within the first 20, or first 15, or first 10 amino acids of the wild-type IL-2 sequence in question), in combination with one amino acid substitution elsewhere in the IL-2 cytokine.

In one embodiment, the variant IL-2 cytokine comprises (or consists of) 1 or 2 amino acid deletions from the N-terminal sequence (e.g. within the first 20, or first 15, or first 10 amino acids of the wild-type IL-2 sequence in question), in combination with up to 4 (e.g. 1, 2, 3 or 4) amino acid substitutions elsewhere in the IL-2 cytokine. In one embodiment, the variant IL-2 cytokine comprises (or consists of) 1 or 2 amino acid deletions from the N-terminal sequence (e.g. within the first 20, or first 15, or first 10 amino acids of the wild-type IL-2 sequence in question), in combination with up to 3 (e.g. 1, 2 or 3) amino acid substitutions elsewhere in the IL-2 cytokine. In one embodiment, the variant IL-2 cytokine comprises (or consists of) 1 or 2 amino acid deletions from the N-terminal sequence (e.g. within the first 20, or first 15, or first 10 amino acids of the wild-type IL-2 sequence in question), in combination with up to 2 (e.g. 1 or 2) amino acid substitutions elsewhere in the IL-2 cytokine. In one embodiment, the variant IL-2 cytokine comprises (or consists of) 1 or 2 amino acid deletions from the N-terminal sequence (e.g. within the first 20, or first 15, or first 10 amino acids of the wild-type IL-2 sequence in question), in combination with one amino acid substitution elsewhere in the IL-2 cytokine.

Substitutions elsewhere in the IL-2 cytokine are defined further in aspect 44 hereinbelow.

Particular IL-2 cytokines and variant IL-2 cytokines are further defined in aspects 40 to 45 hereinbelow.

The amino acid sequence of the α-chain of human IL-2 is provided in Seq ID No:327. The amino acid sequence of the β-chain of human IL-2 is provided in Seq ID No:328. The amino acid sequence of the γ-chain of human IL-2 is provided in Seq ID No:239.

In any of the aspects or concepts herein, an immunocytokine or anti-PDL1 antibody or fragment may have a half-life of at least 4 hours, 5 hours, 6 hours, 7 hours or 8 hours. In another embodiment, the half-life of any of the immunocytokines or anti-PD-L1 antibodies or fragments provided herein is at least 9 hours, or at least 10 hours, or at least 11 hours, or at least 12 hours. In another embodiment, the half-life of any of the immunocytokines or anti-PD-L1 antibodies or fragments provided herein is at least 13 hours, or at least 14 hours, or at least 15 hours, or at least 16 hours. In another embodiment, the half-life of any of the immunocytokines or anti-PD-L1 antibodies or fragments provided herein is at least 17 hours, or at least 18 hours, or at least 19 hours, or at least 20 hours. In another embodiment, the half-life of any of the immunocytokines or anti-PD-L1 antibodies or fragments provided herein is at least 21 hours, or at least 22 hours, or at least 23 hours, or at least 24 hours. In another embodiment, the half-life of any of the immunocytokines or anti-PD-L1 antibodies or fragments provided herein is at least 25 hours, or at least 26 hours, or at least 27 hours, or at least 30 hours. In another embodiment, the half-life of any of the immunocytokines or anti-PD-L1 antibodies or fragments provided herein is at least 32 hours, or at least 34 hours, or at least 36 hours, or at least 40 hours. In one embodiment, the half-life is determined in a mouse model (for example a human PD-L1 knock-in mouse, e.g. as described in Example 22 hereinbelow, or in an immunocompromised mouse xenografted with human T-cells). In another embodiment, the half life is determined in a single dose study in cynomolgus monkeys (e.g. as described in Example 18 or Example 23 hereinbelow). In another embodiment, the half life is determined in an extended single dose study in cynomolgus monkeys (e.g. as described in Example 19 or Example 26 hereinbelow).

Aspect 1a. An immunocytokine comprising an immunoglobulin heavy chain and an immunoglobulin light chain, wherein the heavy chain comprises in N- to C-terminal direction:
a) A $V_H$ domain comprising CDRH1, CDRH2 and CDRH3; and
b) A heavy chain constant region;
and wherein the light chain comprises in N- to C-terminal direction:
c) A $V_L$ domain comprising CDRL1, CDRL2 and CDRL3;
d) A light chain constant region, $(C_L)$;
e) Optionally, a linker, (L); and
f) An IL-2 cytokine;
wherein the $V_H$ domain and $V_L$ domain are comprised by an antigen-binding site that specifically binds to an antigen selected from: an immune checkpoint inhibitor (such as PD-1, CTLA-4, TIGIT, TIM-3, LAG-3 and VISTA, e.g. TIGIT, TIM-3 and LAG-3), an immune modulator (such as BTLA, hHVEM, CSF1R, CCR4, CD39, CD40, CD73, CD96, CXCR2, CXCR4, CD200, GARP, SIRPα, CXCL9, CXCL10, CXCL11 and CD155, e.g. GARP, SIRPα, CXCR4, BTLA, hVEM and CSF1R), and an immune activator (such as CD137, GITR, OX40, CD40, CXCR3 (e.g. agonistic activity against CXCR3), CD27, CD3 and ICOS (e.g. agonistic activity against ICOS), for example, ICOS, CD137, GITR and OX40).

In another embodiment, the antigen-binding site that specifically binds to an antigen selected from: an immune checkpoint inhibitor (such as PD-1, CTLA-4, TIGIT, TIM-3, LAG-3 and VISTA, e.g. TIGIT, TIM-3 and LAG-3), an immune modulator (such as BTLA, hHVEM, CSF1R, CCR4, CD39, CD40, CD73, CD96, CXCR2, CXCR4, CD200, GARP, SIRPα, CXCL9, CXCL10 and CD155, e.g. GARP, SIRPα, CXCR4, BTLA, hVEM and CSF1R), and an immune activator (such as CD137, GITR, OX40, CD40, CXCR3 (e.g. agonistic activity against CXCR3), CD3 and ICOS (e.g. agonistic activity against ICOS), for example, ICOS, CD137, GITR and OX40).

Any of the embodiments of aspect 1 apply mutatis mutandis to aspect 1a. Any of the features or embodiments of aspects 2 to 54 apply mutatis mutandis to aspect 1a. Any of the features of the antibodies or other embodiments or features of concepts 1 to 70 apply mutatis mutandis to aspect 1a.

In one embodiment, the antigen-binding site specifically binds PD-L1, e.g. hPD-L1. In one embodiment, the PD-L1 antigen-binding site comprises the CDRH1, CDRH2, CDRH3, CDRL1, CDRL2 and CDRL3, or the $V_H$, or the $V_L$ or the $V_H$ and $V_L$ region from any one of the anti-PD-L1 antibodies selected from atezolizumab/MPDL3280A (Roche), avelumab/MSB0010718C (Merck), BMS-936559/MDX-1105 (BMS), durvalumab/Medi4736 (Medimmune), KN-035, CA-170, FAZ-053 M7824, ABBV-368, LY-3300054, GNS-1480, YW243.55.S70, REGN3504 and any of the PD-L1 antibodies disclosed in WO2017/034916, WO2017/020291, WO2017/020858, WO2017/020801, WO2016/111645, WO2016/050721, WO2016/197367, WO2016/061142, WO2016/149201, WO2016/000619, WO2016/160792, WO2016/022630, WO2016/007235, WO2015/179654, WO2015/173267, WO2015/181342, WO2015/109124, WO2015/195163, WO2015/112805, WO2015/061668, WO2014/159562, WO2014/165082, WO2014/100079, WO2014/055897, WO2013/181634, WO2013/173223, WO2013/079174, WO2012/145493, WO2011/066389, WO2010/077634, WO2010/036959, WO2010/089411 or WO2007/005874, which antibodies and sequences are incorporated herein by reference.

In one embodiment, the antigen-binding site specifically binds ICOS, e.g. hICOS. In one embodiment, the antigen-binding site specifically binds ICOS, e.g. hICOS and is an agonist to ICOS, e.g. hICOS. In one embodiment, the antigen-binding site specifically binds ICOS, e.g. hICOS and is an antagonist to ICOS, e.g. hICOS. In one embodiment, the ICOS antigen-binding site comprises the CDRH1, CDRH2, CDRH3, CDRL1, CDRL2 and CDRL3, or the $V_H$, or the $V_L$ or the $V_H$ and $V_L$ region from any one of the anti-ICOS antibodies described in arrangement 5 and arrangement 5a hereinbelow, and any of the anti-ICOS antibodies described in sentences 1 to 102 and sentences 1a to 21a.

In any of the following embodiments, a particular antigen-binding site specifically binds to a human target. In one embodiment, the antigen-binding site specifically binds an immune checkpoint inhibitor. In one embodiment, the antigen-binding site specifically binds an immune checkpoint inhibitor selected from PD-1, CTLA-4, TIGIT, TIM-3, LAG-3 and VISTA. In one embodiment, the antigen-binding site specifically binds an immune checkpoint inhibitor selected from TIGIT, CTLA-4, TIM-3 and LAG-3.

In one embodiment, the antigen-binding site specifically binds PD-1, e.g. human PD-1. In one embodiment, the PD-1 antigen-binding site comprises the CDRH1, CDRH2, CDRH3, CDRL1, CDRL2 and CDRL3, or the $V_H$, or the $V_L$ or the $V_H$ and $V_L$ region from pembrolizumab (Keytruda®/MK-3475), nivolumab (Opdivo®/BMS-936558/MDX-1106), MEDI-0680/AMP514, PDR001, Lambrolizumab, BMS-936558, REGN2810, BGB-A317, BGB-108, PDR-001, SHR-1210, JS-001, JNJ-63723283, AGEN-2034, PF-06801591, genolimzumab, MGA-012, IBI-308, BCD-100, TSR-042 ANA011, AUNP-12, KD033, MCLA-134, mDX400, muDX400, STI-A1110, AB011, 244C8, 388D4, XCE853, or pidilizumab/CT-011, or from any one of the anti-PD-1 antibodies described in WO2015/112800 & US2015/0203579 (including the antibodies in Tables 1 to 3), U.S. Pat. Nos. 9,394,365, 5,897,862 and 7,488,802, WO2017/087599 (including antibody SSI-361 and SHB-617), WO2017/079112, WO2017/071625 (including deposit C2015132, hybridoma LT004, and antibodies 6F5/6 F5 (Re), 6F5H1 L1 and 6F5 H2L2), WO2017/058859 (including PD1AB-1 to PD1AB-6), WO2017/058115 (including 67D9, c67D9, and hu67D9), WO2017/055547 (including 12819.15384, 12748.15381, 12748.16124, 12865.15377, 12892.15378, 12796.15376, 12777.15382, 12760.15375 and 13112.15380), WO2017/040790 (including AGEN2033w, AGEN2034w, AGEN2046w, AGEN2047w, AGEN2001w and AGEN2002w), WO2017/025051 & WO2017/024515 (including 1.7.3 hAb, 1.49.9 hAb, 1.103.11 hAb, 1.103.11-v2 hAb, 1.139.15 hAb and 1.153.7 hAb), WO2017/025016 & WO2017/024465 (including antibody A to antibody I), WO2017/020858 & WO2017/020291 (including 1.4.1, 1.14.4, 1.20.15 and 1.46.11), WO2017/019896 & WO2015/112900 & US2015/0210769 (including BAP049-hum01 to BAP049-hum16 and BAP049-Clone-A to BAP049-Clone-E), WO2017/019846 (including PD-1 mAb 1 to PD-1 mAb 15), WO2017/016497 (including MHC723, MHC724, MHC725, MHC728, MHC729, m136-M13, m136-M19, m245-M3, m245-M5 and m136-M14), WO2016/201051 (including antibody EH12.2H7, antibody hPD-1 mAb2, antibody hPD-1 mAb7, antibody hPD-1 mAb9, antibody hPD-1 mAb15, or an anti-PD-1 antibody selected from Table 1), WO2016/197497 (including DFPD1-1 to DFPD1-13), WO2016/197367 (including 2.74.15 and 2.74.15.hAb4 to 2.74.15.hAb8), WO2016/196173 (including the antibodies in Table 5, and FIGS. 1-5), WO2016/127179 (including R3A1, R3A2, R4B3, and R3D6), WO2016/077397 (including the antibodies described in Table 1 of Example 9), WO2016/106159 (including the murine antibodies in Table 3 of Example 2 and the humanised antibodies in Tables 7, 8 and 9 of Example 3), WO2016/092419 (including C1, C2, C3, EH12.1, mAb7-G4, mAb15-G4, mAb-AAA, mAb15-AAA), WO2016/068801 (including clone A3 and its variants and the other antibodies described in FIGS. 1 to 4), WO2016/014688 (including 10D1, 4C10, 7D3, 13F1, 15H5, 14A6, 22A5, 6E1, 5A8, 7A4, and 7A4D and the humanised antibodies of Examples 9/10), WO2016/015685 (including 10F8, BA08-1, BA-08-2 and 15H6), WO2015/091911 & WO2015/091910 (including the anti-canine PD-1 antibodies in Examples 2, 3 and 4), WO2015/091914 (including the anti-canine PD-1 antibodies in Table 3), WO2015/085847 (including mAb005, H005-1 to H005-4), WO2015/058573 (including cAB7), WO2015/036394 (including LOPD180), WO2015/035606 (including the antibodies in Table 1 of Example 2, in Tables 14, 15 and 16 of Example 7 and in tables 20, 21 and 22 of Example 11), WO2014/194302 (including GA2, RG1B3, RG1H10, RG2A7, RG2H10, SH-A4, RG4A6, GA1, GB1, GB6, GH1, A2, C7, H7, SH-A4, SH-A9, RG1H11, and RG6B), WO2014/179664 (including 9A2, 10B11, 6E9, APE1922, APE1923, APE1924, APE1950, APE1963 and APE2058), WO2014/206107 (including clone 1, 10, 11, 55, 64, 38, 39, 41 and 48), WO2012/135408 (including h409A11, h409A16, and h409A17), WO2012/145493 (including antibodies 1E3, 1E8, 1H3 and h1H3 Var 1 to h1H3 Var 14), WO2011/110621 (including antibody 949 and the modified versions disclosed in FIGS. 1 to 11), WO2011/110604 (including antibody 948 and the modified versions disclosed in FIGS. 3 to 11), WO2010/089411 (including CNCM deposit number 1-4122, 1-4080 or 1-4081), WO2010/036959 (including the antibodies in Table 1 of Example 1), WO2010/029435 & WO2010/029434 (including clones 2, 10 and 19), WO2008/156712 (including hPD-1.08A, hPD-1.09A, h409A11, h409A16 and h409A17 and the antibodies described in Example 2, Table H, Example 4 and table IV), WO2006/121168 (including clones 17D8, 4H1, 5C4, 4A11, 7D3, 5F4, and 2D3), WO2004/004771 or WO2004/056875 (including PD1-17, PD1-28, PD1-33, PD1-35, PD1-F2 and the Abs described in Table 1); the sequences and features of the anti-PD-1 antibodies are incorporated herein by reference.

In one embodiment, the antigen-binding site specifically binds CTLA-4, e.g. hCTLA-4. In one embodiment, the CTLA-4 antigen-binding site comprises the CDRH1, CDRH2, CDRH3, CDRL1, CDRL2 and CDRL3, or the $V_H$, or the $V_L$ or the $V_H$ and $V_L$ region from ipilimumab (MDX-010, CAS No. 477202-00-9), tremelimumab (ticilimumab/CP-675,206), antibody clone 2F1, clone 1F4 (Abnova Corporation), clone 9H10 (EMD Millipore), clone BNU3 (GeneTex), clone 1 E2, clone AS32 (Lifespan Biosciences) clone A3.4H2.H12 (Acris Antibodies), clone 060 (Sino Biological), clone BU5G3 (Creative Diagnostics), clone MIH8 (MBL International), clone A3.6B10.G1, or clone L3D10 (BioLegend) or from any one of the anti-CTLA-4 antibodies described in WO2017/087588 (ISVs disclosed in FIG. 2), WO2017/084078 (clones C2, C4, C10, C11, C12 and C13, and FIGS. 4-7), WO2016/196237 (including AGEN1884w, AGEN2041w, the sequences in FIGS. 19A, 19B and Tables 1-6), WO2016/130986 & WO2016/130898 (including E8, F7 and the Abs described in Table 4), WO2016/015675 (including hybridoma LT001 and antibodies 8D2, 8D2H1L1, 8D2H2L2, 8D2H3L3, 8D2H2L15 and 8D2H2L17), WO2012/120125 (including 3B10, 8H5, and the Abs identified in Examples 1, 2, 3 and 5), WO2010/097597 (including JMW-3B3 and the variants and fragments disclosed), WO2009/100140 (including 10D1, 1H5, 3A4, 6C10 and the antibodies described in FIGS. 1 to 6), WO2007/008463 & WO2006/101692 & WO2006/101691 & WO2006/048749 & WO2005/09238, (including 4.1.1, 4.8.1, 4.10.2, 4.13.1, 4.14.3, 6.1.1, 11.2.1, 11.6.1, 11.7.1, 12.3.1.1, 12.9.1.1, and 10D1), WO2006/096491 (including ATCC Deposit No. 11.2.1 11.2.1.4 PTA-5169 and 4.1.1 4.1.1.1 PTA-5166), WO2006/066568 (including TGN2122.C, TGN2422.C, 4.8H10H5 and 4.3F6B5 and the antibodies described in tables 3 to 14), WO2006/029219 (including L3D10, L1B11, K4G4, KM10, and YL2), WO2004/029069 (including ATCC deposit number PTA-4537), WO01/54732 (including antibodies 25, 26, 27, 29, 33, 34, 35, 36 and 38), WO01/14424 (including 3A4, 9A5, 2E2, 2E7, 4B6, 4E10, 5C4, 5G1, 11E8, and 11G1 and the antibodies identified in Examples 3 and 4 and table 3) and WO00/37504 (including 3.1.1, 4.1.1, 4.8.1, 4.10.2, 4.13.1, 4.14.3, 6.1.1, 11.2.1, 11.6.1, 11.7.1, 12.3.1.1, and 12.9.1.1); the sequences and features of the anti-CTLA-4 antibodies are incorporated herein by reference.

In one embodiment, the antigen-binding site specifically binds TIGIT, e.g. human TIGIT. In one embodiment, the TIGIT antigen-binding site comprises the CDRH1, CDRH2, CDRH3, CDRL1, CDRL2 and CDRL3, or the $V_H$, or the $V_L$ or the $V_H$ and $V_L$ region from RG-6058 (MTIG-7192A) or from any one of the anti-TIGIT antibodies described in WO2017/053748 (including 1A4, 1D3, 4A3, 10A7, 4.1D3.Q1E, h10A7.K4G3, 4.1D3 and the other antibodies described in Examples 1 and 2), WO2017/037707 (including VSIG9 #1 and 258-csl #4), WO2017/030823 (including 14D7, 26B10 and humanized versions in Example 3), WO2016/191643 (including 313R11, 313R12, 313R14, 313R19, 313R20, ATCC PTA-122180 and ATCC PTA-122181), WO2016/106302 (including 14B2, 13E6, 6F9, 11G11, 10C9, 16F6, 11C9, 27A9, 10D7, 20G6, 24E8, 24G1, 27F1, 15A6, 4E4, 13D1, 9B11, 10B8, 22G2, 19H2, 8C8, 17G4, 25E7, 26D8 and 16A8), WO2016/028656 (including 14A6, 28H5 or 31C6 and humanized versions from Example 6), and WO2009/126688 (US2013/0251720, including 10A7 and 1F4); the sequences and features of the anti-TIGIT antibodies are incorporated herein by reference.

In one embodiment, the antigen-binding site specifically binds TIM-3, e.g. human TIM-3. In one embodiment, the TIM-3 antigen-binding site comprises the CDRH1, CDRH2, CDRH3, CDRL1, CDRL2 and CDRL3, or the $V_H$, or the $V_L$ or the $V_H$ and $V_L$ region from F38-2E2 (BioLegend), clone 2E2 (Merck Millipore), clone 6B6E2, clone 024 (Sino Biological) clone 344801 (R&D Systems), clone E-18, clone H-191 (Santa Cruz Biotechnology), or clone 13A224 (United States Biological), TSR-022 (Tesaro) or from any one of the anti-TIM-3 antibodies described in WO2017/079115 (including anti-TIM3 antibodies listed in tables 30-38), WO2017/055404 (including PD1TIM3-0389, PD1TIM3-0168, PD1TIM3-0166, TIM3-0038, TIM3-0018, TIM3-0028, TIM3-0438—Table C), WO2017/031242 (Table 10), WO2016/179194 (including antibodies in FIG. 1b, including mAb F38-2E2 and 2E2), WO2016/171722 (including 344823 and antibodies from the hybridomas 7D11, 10G12, 11G8, 8B.2C12 and 25F.1D6), WO2016/161270 (including APE5137 and APE5121), WO2016/111947 (including mAb5, mAb13, mAb15, mAb17, mAb21, mAb22, mAb26, mAb27, mAb48, mAb58 and mAb91), WO2016/071448 (including TIM3-0016, TIM3-0018, TIM3-0021, TIM3-0022, TIM3-0026, TIM3-0028, TIM3-0030, TIM3-0033, TIM3-0038, TIM3-0433, TIM3-0434, TIM3-0438 and TIM3-0443), WO2016/068802 (including 1B9, 1H9, 1H10, 2C7, 2F4, 2G6, 1D9, 1F4 and 2C8—FIGS. 1, 2 & 3), WO2016/068803 (including A3, B10, G6, G7, G9, A11 and A11_gl—FIGS. 1, 2 & 3), WO2015/117002 (including ABTIM3, ABTIM3-hum02, ABTIM3-hum05, ABTIM3-hum06, ABTIM3-hum09, ABTIM3-hum10, ABTIM3-hum12, ABTIM-hum01, ABTIM-hum04, ABTIM3-hum07, ABTIM3-hum08, ABTIM3-hum04, ABTIM3-hum21, ABTIM3-hum03, ABTIM3-hum11 and antibodies listed in Table 9), WO2015/048312 (including 5D12), WO2014/022332 (including 2C12), WO2013/006490 (including antibodies in Table 1), WO2011/155607 (including 512, 644, 4545, 4177, 8213, 344823 and 34823), WO2003/063792 (including antibody 8B.2C12 and 25F.1D6), WO2017/019897 (including antibody molecules disclosed in Tables 1-4, including ABTIM3, ABTIM3-hum20, ABTIM3-hum22 and ABTIM3-hum23), WO2016/079050 & WO2016/079050 (including Tim3_0022, Tim3_0016, Tim3_0018, Tim3_00122, Tim3_0022, Tim3_0021, Tim3_0028, Tim3_0026, Tim3_0033, Tim3_0038, Tim3_0030, 1.7.E10, F38-2EL and 27-12E12); the sequences and features of the anti-TIM-3 antibodies are incorporated herein by reference.

In one embodiment, the antigen-binding site specifically binds LAG-3, e.g. human LAG-3. In one embodiment, the LAG-3 antigen-binding site comprises the CDRH1, CDRH2, CDRH3, CDRL1, CDRL2 and CDRL3, or the $V_H$, or the $V_L$ or the $V_H$ and $V_L$ region from antibody clone 17B4 (Enzo Life Sciences), or clone 333210 (R&D Systems), or clone 14L676 (United States Biological), or C9B7W (PharMingen), or 11E, or IM0321, or mAb C9B7W (BioXcell) or from any one of the anti-LAG-3 antibodies described in WO95/30750, WO2004/078928, WO2008/132601 (including IMP731 Lag-3 Ab, IMP321, A9H12 Lag-3 mAb and 31G11), WO2010/019570 (including 25F7, 26H10, 25E3, 8B7, 11F2 and 17E5), WO2014/140180 (including H5L7, H5L7BW, IMP731 and antibodies in Tables 3 & Table 7), WO2014/179664 (including APE03109), WO2014/008218 (including Lag3.1, Lag3.5, Lag3.6, Lag3.7 and Lag3.8), WO2015/042246, WO2015/116539 (including BMS-986016), WO2015/138920 (including BAP050-hum01 to BAP050-hum20, huBAP050(Ser), BAP050-hum0l-Ser to BAP050-hum20-Ser, BAP050-Clone-F, BAP050-Clone-G, BAP050-Clone-H, BAP050-Clone-I, BAP050-Clone-J, BAP050 and BAP050-chi), WO2015/198312, WO2016/028672 (including Ab1, Ab2, Ab3, Ab4, Ab5, Ab6, Ab7, Ab8 and Ab9), WO2016/126858, WO2016/200782 (including LAG-3 mAb1 to LAG-3 mAb6), WO2017/015560 (including L32D10, L3E3, L3C5, L35D4, L35G6, L33H11, L32A9, L32A4, L3A1 and the antibodies listed in Table 3), WO2017/062888 (including mAb1, H4H15477P, H4H15483P, H4H15484P, H4H15491, H4H17823P, H4H17826P2, H4H17828P2, H4sH15460P, H4sH15462P, H4sH15463P, H4sH15464P, H4sH15466P, H4sH15467P, H4sH15470P, H4sH15475P, H4sH15479P, H4sH15480P, H4sH15482P, H4sH15488P, H4sH15496P2, H4sH15498P2, H4sH15505P2, H4sH15518P2, H4sH15523P2, H4sH15530P2, H4sH15555P2, H4sH15558P2, H4sH15567P2 and H4H17819P), WO2017/019894, WO2017/037203 (including 8E2, 13E2, 34F4, 17B4 and IMP761), WO2017/087589 (including 11B09) or WO2017/087901; the sequences and features of the anti-LAG-3 antibodies are incorporated herein by reference.

In one embodiment, the antigen-binding site specifically binds VISTA, e.g. human VISTA. In one embodiment, the VISTA antigen-binding site comprises the CDRH1, CDRH2, CDRH3, CDRL1, CDRL2 and CDRL3, or the $V_H$, or the $V_L$ or the $V_H$ and $V_L$ region from any one of the anti-VISTA antibodies described in WO2016/207717 & WO2015/097536 (including VSTB50, VSTB53, VSTB60, VSTB95, VSTB112, VSTB116, VSTB174, VSTB175, VSTB149, VSTB140 and the antibodies in Table 1A and Examples 7 and 8) and WO2014/190356 (including clone 2D3 and 18C3); the sequences and features of the anti-VISTA antibodies are incorporated herein by reference.

In one embodiment, the antigen-binding site specifically binds an immune modulator. In one embodiment, the antigen-binding site specifically binds an immune modulator selected from BTLA, hHVEM, CSF1R, CCR4, CD39, CD40, CD73, CD96, CXCR2, CXCR4, CD200, GARP, SIRPα, CXCL9, CXCL10, CXCL11 and CD155, or from BTLA, hHVEM, CSF1R, CCR4, CD39, CD40, CD73, CD96, CXCR2, CXCR4, CD200, GARP, SIRPα, CXCL9, CXCL10 and CD155. In one embodiment, the antigen-binding site specifically binds an immune modulator selected from GARP, SIRPα, CXCR4, BTLA, hVEM and CSF1R.

In one embodiment, the antigen-binding site specifically binds GARP, e.g. human GARP. In one embodiment, the GARP antigen-binding site comprises the CDRH1, CDRH2, CDR3, CDRL1, CDRL2 and CDRL3, or the $V_H$, or the $V_L$ or the $V_H$ and $V_L$ region from G14D9, Plato-1, 272, G6, G10 or 7B11 or from any of one of the anti-GARP antibodies described in WO2007/113301& WO2015/015003 (including MHGARP8, LHG-10, LHG-10-D, LHG-10.3-D, LHG-10.4-D, LHG-10.5-D, LHG-10.6-D, LHG-10.3, LHG-10.4, LHG-10.5, LHG-10.6, 27E10, MHGARP1, MHGARP2, MHGARP3, MHGARP4, MHGARP5, MHGARP6, MHGARP7 and MHGARP9), WO2017/051888 (including 110F, 105F, c151D, c198D, h198D, h151D, h151D-H1L1 and h198D-H3L4); the sequences and features of the anti-GARP antibodies are incorporated herein by reference.

In one embodiment, the antigen-binding site specifically binds SIRPα, e.g. human SIRPα. In one embodiment, the SIRPα antigen-binding site comprises the CDRH1, CDRH2, CDRH3, CDRL1, CDRL2 and CDRL3, or the $V_H$, or the $V_L$ or the $V_H$ and $V_L$ region from ED9 (ThermoFisher), or 602411 (Novus Biologicals), or from any one of the anti-SIRPα antibodies described in WO97/48723, WO00/24869 (including 10C4), WO00/66159 (including ED9 and ED17), WO01/40307, WO02/092784 (including SE5A5, SE7C2 and SE12C3), WO2004/108923 (including SE12C3 and 2F34), WO2009/046541 (including P84), WO2011/076781, WO2012/172521, WO2012/040207 (including SE5A5 and mouse P84), WO2013/056352 (including 29-AM4-5, Ab AM4-5, AM5-1, AM5-3, AM5-5, AM5-6, SIRPalpha-AM3-35, AM4-1, SIRP29-AM3-35, SIRP29-AM4-5, SIRP29-AM4-1, 29-AM2-2, 29-AM4-4, 29-AM4-1, 29-AM4-5, 29-AM3-35 and SIRP29-AM3-63), WO2016/063233, WO2016/205042 (including P362) or WO2015/138600 (including KWAR23); the sequences and features of the anti-SIRPα antibodies are incorporated herein by reference.

In one embodiment, the antigen-binding site specifically binds CXCR4, e.g. human CXCR4. In one embodiment, the CXCR4 antigen-binding site comprises the CDRH1, CDRH2, CDRH3, CDRL1, CDRL2 and CDRL3, or the $V_H$, or the $V_L$ or the $V_H$ and $V_L$ region of ulocuplumab/BMS-936564, clone 44717.111 or PF-06747143 or from any one of the anti-CXCR4 antibodies described in WO97/49424 (including MAB12G5), WO99/50461, WO01/42308, WO03/066830 & WO2003/066830 (including Ab124 and Ab125), WO2004/059285 (including ALX40-4C), WO2006/089141 (including mAbs 2N, 6R, 18, 19, 20, 33 and 48), WO2007/005605, WO2008/142303 (including MAB170, MAB171, MAB173 and MAB172), WO2008/060367 & WO2013/071068 & WO2015/015401 (including BMS-936564/MDX-1338), WO2009/140124 (including antibody I, II, III, IV and V), WO2009/117706 (including 701, 708, 716, 717, 718 and 4G10), WO2011/161266 (including 4CXCR100, 4CXCR103, 4CXCR104, 4CXCR101, 4CXCR238D2 and 4CXCR238D4), WO2011/098762 (including C-9P21 (Table 1), B-1M22 (Table 2), C1124 (Table 3), D-1K21 (Table 4) and 9N10 (Table 5)), WO2012/175576, WO2013/013025 (including 2A4, 6C7, 4C1, 7C8, 5C9 and 5E1), WO2013/017566 (including Mab 427aB1 and 515H7), WO2013/017562 (including 1-3859 Mab and 515H7), WO2015/069874 (including antibodies corresponding to Seq ID numbers 25 and 29), WO2015/015401 (including 12A11, 6B6, 3G10, m3G10.hIgG1, m3G10.hIgG4, h3G10.A57.hIgG1, h3G10.A57.A58A.hIgG1, h3G10.1.91.A58A.hIgG1, h3G10.1.91.A58B.hIgG1 and h3G10.2.37.2.72.hIgG1), WO2016/156570 (including 281F12, 281A6 and 281D4), WO2016/109872 (including antibodies listed in tables 1, 2, 9 & 12, M3-114-6H, AM4-272-6H, AM3-523-6H, AM4-272, AM3-114, AM3-523, AM4-746 and AM4-1121), WO2017/071625, WO2012/175576, WO2010/125162 & WO2012/055980 & WO2011/121040 & WO2010/037831 (including c414H5 (414H5), c515H7 (515H7) and 301aE5), WO2009/138519 (including ALX40-4C, 238D2, 238D4, 237B5 antibodies and sequences listed in table 1, table 1.1, table A-I, table B-1.1 & B-5), WO2011/042398 (including 238D2 and 238D4), WO2011/083140 (including those disclosed in Tables C-2, C-3, C-4 & C-5, FIG. 2 and ALX-0651, 15H3, 10E12, 10G10, 238B6, 10E9, 281E10, 10A10, 14A2 and 15A1) or WO2011/083141; the sequences and features of the anti-CXCR4 antibodies are incorporated herein by reference.

In one embodiment, the antigen-binding site specifically binds BTLA, e.g. hBTLA. In one embodiment, the BTLA antigen-binding site comprises the CDRH1, CDRH2, CDRH3, CDRL1, CDRL2 and CDRL3, or the $V_H$, or the $V_L$ or the $V_H$ and $V_L$ region from antibody clone 1B7, clone 2G8, clone 4C5 (Abnova Corporation), clone 4B8 (antibodies-online), clone MIH26 (Thermo Scientific Pierce Antibodies), clone UMAB61 (OriGene Technologies), clone 330104 (R&D Systems), clone 1B4 (Lifespan Biosciences), clone 440205, clone 5E7 (Creative Diagnostics) or from any one of the anti-BTLA antibodies described in WO2016/176583 (including clone 6F4), WO2011/014438 (including 8D5, 8A3, 20H4, 21H6, 15C5, 19A7 and 4C7), WO2010/106051 (including CNCM deposit number 1-4123) and WO2008/076560 (including 1B4, E4H9, 3C2, 3C2a, 6A5, 11E2, E8D9, 10H6 and 4C9 as detailed in Example 2); the sequences and features of the anti-BTLA antibodies are incorporated herein by reference.

In one embodiment, the antigen-binding site specifically binds hVEM, e.g. human hVEM. In one embodiment, the HVEM antigen-binding site comprises the CDRH1, CDRH2, CDRH3, CDRL1, CDRL2 and CDRL3, or the $V_H$, or the $V_L$ or the $V_H$ and $V_L$ region from any one of the anti-HVEM antibodies described in WO2008/083169 (including LBH1); the sequences and features of the anti-BTLA antibodies are incorporated herein by reference.

In one embodiment, the antigen-binding site specifically binds CSF1R. In one embodiment, the CSF1R antigen-binding site comprises the CDRH1, CDRH2, CDRH3, CDRL1, CDRL2 and CDRL3, or the $V_H$, or the $V_L$ or the $V_H$ and $V_L$ region from any one of the anti-CSF1R antibodies described in WO2009/026303 (including 1.2, 1.109, 2.360 and 1.2.SM and the antibodies in FIGS. 1 and 2), WO2009/112245 (including CXIIG6), WO2011/070024 (including Mab 2F11, 2E10, 2H7 and 1G10, and their derivatives), WO2011/107553 (including 7H5.2G10/DSM ACC2922), WO2011/123381 (including antibody 1 and antibody 2), WO2011/131407 (including 7G5.3B6/DSM ACC2921), WO2011/140249 (including 0301, 0302, and 0311 their derivatives and the antibodies in tables 2, 3 and 5), WO2013/169264 & WO2014/036357 & WO2016/106180 & WO2016/168149 (including huAb1 to huAb16), WO2012/110360 & WO2013/057281 (including CXIIG6, H19K12, H27K5 and H27K15 and the humanised antibodies of tables 1 and 2), WO2013/087699 (including 9D11.2E8 and 10H2.2F12), WO2014/072441 (including H27K15), WO2014/173814 & WO2013/132044 (including Mab 2F11, Mab 2E10, Mab 2H7, Mab 1G10 and sc2-4A5 and the antibodies in Table 3 and 3b), WO2015/028455 & WO2015/028454 (including Ab535, Ab969, and derivatives, e.g. Ab969.g2), WO2015/036511 & WO2016/207312 (including 2F11, 2E10 and the derivatives described in embodiment 33) and WO2017/049038 (including ALM-423 and the antibodies listed in Table 2); the sequences and features of the anti-CSF1R antibodies are incorporated herein by reference.

In one embodiment, the antigen-binding site specifically binds CD39, e.g. human CD39. In one embodiment, the CD39 antigen-binding site comprises the CDRH1, CDRH2, CDRH3, CDRL1, CDRL2 and CDRL3, or the $V_H$, or the $V_L$ or the $V_H$ and $V_L$ region from BY40, BY12, BA54g (Biolegend), BU61 (Santa Cruz Biotech), A1 (Ebiosciences), AC2 (Immunotech), 22A9 (Abcam), 24DMS1 or any one of the anti-CD39 antibodies described in WO96/32471, WO00/04041, WO01/10205 (including CD39L4), WO2009/09547 (including CNCM-I-3889/BY40), WO2014/169255, WO2012/085132 (including antibodies VY12, BY40 and BA54g), WO2016/073845 (including R29-5-13A, R29-5-71A, R29-5-165C and R29-9-8B), WO2017/089334 (including 1-391, 1-392 and antibodies produced from hybridomas I-3889 and CNCM I-41171) and WO2009/095478; the sequences and features of the anti-CD39 antibodies are incorporated herein by reference.

In one embodiment, the antigen-binding site specifically binds CD40, e.g. human CD40. In one embodiment, the CD40 antigen-binding site comprises the CDRH1, CDRH2, CDRH3, CDRL1, CDRL2 and CDRL3, or the $V_H$, or the $V_L$ or the $V_H$ and $V_L$ region from BMS3h-56-269, CP-870,893, dacetuzumab, SEA-CD40, ADC-1013, RO7009789 and Chi Lob 7/4, or from any one of the anti-CD40 antibodies described in WO2017/059243, WO2017/059196, WO2017/040932, WO2017/040566, WO2017/004016, WO2017/004006, WO2016/196314, WO2016/028810, WO2016/023960, WO2016/023875, WO2015/134988, WO2015/091853, WO2014/070934, WO2014/065403, WO2014/065402, WO2014/04298, WO2013/164789, WO2013/034904, WO2012/149356, WO2012/145673, WO2012/125569, WO2012/111762, WO2012/075111, WO2012/065950, WO2012/041635, WO2011/123489, WO2010/123012, WO2010/104761, WO2010/121231, WO2009/062125, WO2010/104747, WO2010/104748, WO2010/104749, WO2010/024676, WO2009/094391, WO2009/062054, WO2008/091954, WO2007/130493, WO2007/129895, WO2007/124299, WO2007/053767, WO2007/053661, WO2006/128103, WO2006/073443, WO2005/063981, WO2005/063289 (US2012/0263732), WO2005/044855, WO2005/044306, WO2005/044294, WO2005/044307, WO2005/044304, WO2005/044854, WO2005/044305, WO03/040170 (US7,563,442B, US7,618,633B, US7,338,660B, US7,288,251B, US7,626,012B, US8,388,971B, US2013/0024956), WO03/029296, WO02/088186, WO01/83755, WO02/28905, WO02/28480, WO02/28481, WO02/28904, WO01/37870, Wo01/16180, WO00/75348 WO99/61057, WO99/42075, WO97/31025, WO95/17202 and WO95/09653; the sequences and features of the anti-CD40 antibodies are incorporated herein by reference.

In one embodiment, the antigen-binding site specifically binds CD73, e.g. human CD73. In one embodiment, the CD73 antigen-binding site comprises the CDRH1, CDRH2, CDRH3, CDRL1, CDRL2 and CDRL3, or the $V_H$, or the $V_L$ or the $V_H$ and $V_L$ region from 1E9 (Santa Cruz Biotechnology), AD2, 7G2, 4G4 or from any one of the anti-CD73 antibodies described in WO2017/064043 (including 7H10, 12F9, 15D7, 4B11, 11D9 and 9D2), WO2016/081748 (including 4C3, 7A11, 6E11, 5F8, 4C3, 11F11, 11A6, CD73.4-1, CD73.4-2, CD73.3, 11F11-1, 11F11-2, 11F11, 4C3-1, 4C3-2, 4C3-3, 4D4, 10D2-1, 10D2-2, 11A6, 24H2, 5F8-1, 5F8-2 and 5F8-3), WO2016/131950 (including 11E1, 8C7, 3C12 and 6E1), WO2016/075176 (including MEDI9447, clone 10.3 and clone 2C5) & WO2016/075099 (including CD730004, CD730008, CD730011, CD730021, CD730042, CD730046, CD730047, CD730068 and CD730069), WO2016/055609 (including 11E1, 6E1, 3C12 and 8C7); the sequences and features of the anti-CD73 antibodies are incorporated herein by reference.

In one embodiment, the antigen-binding site specifically binds CD96, e.g. human CD96. In one embodiment, the CD96 antigen-binding site comprises the CDRH1, CDRH2, CDRH3, CDRL1, CDRL2 and CDRL3, or the $V_H$, or the $V_L$ or the $V_H$ and $V_L$ region of 6A6, or NK92.39 (E bioscience), 1C8, 3H8, MAA6359 or from any one of the anti-CD96 antibodies described in WO2008/073316, WO2009/007124, WO2013/184912, WO2014/089169, WO2014/149310 (including antibody 3.3), WO2015/024060 or WO2015/024042, WO2015/024060 (including mAb 3.3); the sequences and features of the anti-CD96 antibodies are incorporated herein by reference.

In one embodiment, the antigen-binding site specifically binds CXCR2, e.g. human CXCR2. In one embodiment, the CXCR2 antigen-binding site comprises the CDRH1, CDRH2, CDRH3, CDRL1, CDRL2 and CDRL3, or the $V_H$, or the $V_L$ or the $V_H$ and $V_L$ region from any one of the anti-CXCR2 antibodies described in WO2015/169811 (including HY29 and HY29GL), WO2014/170317 (including CX2-Mab #1 to #19), WO2012/062713, WO2013/168108 (including 163D2-127D1, 163E3-127D1, 163E3-54B12, 163D2-54B12, 2B2-163E3, 2B2-163D2, 97A9-2B2, 97A9-54B12, 127D1-163D2, 127D1-163E3, 2B2-97A9, 54B12-163D2, 54B12-163E3, 163D2-2B2, 163E3-2B2, 127D1-97A9, 54B12-97A9, 97A9-127D1 and derivatives thereof), WO2009/117706 (including 48311.211, 5E8/CXCR2, clone 19 and derivatives thereof), WO2009/120186 (including RII115, 48311 and derivatives thereof) and WO2002/26249; the sequences and features of the anti-CXCR2 antibodies are incorporated herein by reference.

In one embodiment, the antigen-binding site specifically binds CD200, e.g. human CD200. In one embodiment, the CD200 antigen-binding site comprises the CDRH1, CDRH2, CDRH3, CDRL1, CDRL2 and CDRL3, or the $V_H$, or the $V_L$ or the $V_H$ and $V_L$ region from DX-109, samalizumab/ALXN-6000, TTI-200.7 or from any one of the anti-CD200 antibodies described in WO99/24565 (including M3B5 and the antibodies in Examples 4 and 5), WO02/11762 (including 3B6 and the antibodies in the Examples), WO2004/060295 (US2004/0213783), WO2004/078938 (including scFv-9), WO2006/020266 (U.S. Pat. No. 8,840,885B2, including CG1R3A10, cG2aR3A10, cG2aR3B7, dGIR3A5, dGIR3B5, and dGIR3B10 and the antibodies described in FIGS. 9A-9C, FIGS. 21A and 21B), WO2007/084321 (U.S. Pat. No. 8,709,415B2, including ALXN5200, hB7VH3VL2, C2aB7G1, C2aB7G2/G4, V3V2-G1 and V3V2-G2/G4), WO2009/014745 (including OX90mG2a (FIG. 10), OX90NE and OX90NE-AG), and WO2011/100538 & US2013/0189258 (including Antibody 1 and Antibody 2); the sequences and features of the anti-CD200 antibodies are incorporated herein by reference.

In one embodiment, the antigen-binding site specifically binds CCR4, e.g. human CCR4. In one embodiment, the CCR4 antigen-binding site comprises the CDRH1, CDRH2, CDRH3, CDRL1, CDRL2 and CDRL3, or the $V_H$, or the $V_L$ or the $V_H$ and $V_L$ region from mogamulizumab, KM3060 (see Niwa et al., 2004, Cancer Research 64, 2127-2133), and KW-0761 (see Ishida et al., Annals of Oncology 2008, vol 19, supplement 4, 513) or from any one of the anti-CCR4 antibodies described in WO2016/178779 & WO2016/057488 (including mAb2-3, 1-44, 1-49, 2-1 and 2-2), WO2015/179236 (including KW-0761), WO2013/166500 (including mAb1567, c1567, h1567, mAb 1-4 and 2-3 and the antibodies in Examples 6 and 13), WO2012/076883 (including antibodies 208, 306, 308, 406, 501, 503, 601, 603 and 803—Tables 1-9), WO2010/142952 (including 17G, 9E, 11F, 9E10, 9E10J and 9E1D—see Tables 1-16), WO2009/086514 (including mAb1567 and the humanised mAbs in Example 14), WO2005/035582 (including the DG44/CCR4 antibody and the Ms705/CCR4 antibody (FERM BP-8467)), WO2005/053741 & WO01/64754 (US6,989,145B, US7,666,418B, US8,197,814B, US8,632,996B, including KM2160 (FERM BP-10090), KM2760 (FERM deposit BP-7054)), WO2003/018635 (including KM2160, KM8759 (FERM BP-8129) and KM8760 (FERM BP-8130), WO00/42074 (US6,488,930B, US7,138,117B, including 2B10, 10E4, 1G1 and the antibodies deposited as ATCC accession number HB-12624 and HB-12625) and WO00/41724 (US6,881,406B, US6,245,332B, including 1G1 and the antibody deposited under ATCC accession number HB-12624; the sequences and features of the anti-CCR4 antibodies are incorporated herein by reference.

In one embodiment, the antigen-binding site specifically binds CXCL9, e.g. human CXCL9. In one embodiment, the CXCL9 antigen-binding site comprises the CDRH1, CDRH2, CDRH3, CDRL1, CDRL2 and CDRL3, or the $V_H$, or the $V_L$ or the $V_H$ and $V_L$ region from mAb 392-100 or AF392 (R&D Systems).

In one embodiment, the antigen-binding site specifically binds CXCL10, e.g. human CXCL10. In one embodiment, the CXCL10 antigen-binding site comprises the CDRH1, CDRH2, CDRH3, CDRL1, CDRL2 and CDRL3, or the $V_H$, or the $V_L$ or the $V_H$ and $V_L$ region of mAb266 (R & D systems) or from any one of the anti-CXCL10 antibodies described in WO017/8708 (including CR.G (IP-10) (IgG1) (PharMingen) ande IP-10 (IgG)(A.Luster), WO02/15932, WO03/006045, WO2004/082714, WO2004/045525, WO2004/045526, WO2004/101511 (including antibodies in table 1 and AIP12, HuAIP12, MuAIP12, AIP13, HuAIP13, MuAIP13, AIP6, AIP8, AIP14, AIP18, AIP21, AIP22, AIP5 and AIP17), WO2005/060457 (including AIP5, AIP6, AIP8, AIP10, AIP12, AIP13, AIP14, AIP17, AIP18, AIP21, AIP22, AIP32 and AIP36), WO2005/011605, WO2005/023201, WO2005/058815 (including 1D4, 1E1, 2G1, 3C4, 6A5, 6A8, 6B10, 7C10, 8F6, 10A12 and 10A12S13C4), WO2005/084708, WO2006/039819, WO2006/118085, WO2008/047486, WO2008/044824 (including antibodies #124, #31, #28, #43 and #137), WO2008/106200, WO2009/023566, WO2012/149320 (including MSX-1100 and 6A5), WO2014/003742 (including the antibody of Example 14), WO2013/170735, WO2014/189306, WO2015/063187; the sequences and features of the anti-CXCL10 antibodies are incorporated herein by reference.

In one embodiment, the antigen-binding site specifically binds CD155, e.g. human CD155. In one embodiment, the CD155 antigen-binding site comprises the CDRH1, CDRH2, CDRH3, CDRL1, CDRL2 and CDRL3, or the $V_H$, or the $V_L$ or the $V_H$ and $V_L$ region from clone SKII.4 (BioLegend).

In one embodiment, the antigen-binding site specifically binds an immune activator. In one embodiment, the antigen-binding site specifically binds an immune activator selected from CD137, GITR, OX40, CD40, CXCR3 (e.g. agonistic activity against CXCR3), CD3 and ICOS (e.g. agonistic activity against ICOS). In one embodiment, the antigen-binding site specifically binds an immune activator selected from ICOS, CD137, GITR and OX40.

In one embodiment, the antigen-binding site specifically binds CD137, e.g. hCD137. In one embodiment, the CD137 antigen-binding site comprises the CDRH1, CDRH2, CDRH3, CDRL1, CDRL2 and CDRL3, or the $V_H$, or the $V_L$ or the $V_H$ and $V_L$ region from urelumab, BMS-663513, PF-05082566 (Pfizer), 1D8 and 3E1, 4B4 (BioLegend 309809), H4-1BB-M127 (BD Pharmingen 552532), BBK.2 (Thermo Fisher M S621PABX), 145501 (Leinco Technologies B591), the antibody produced by cell line deposited as ATCC No. HB-11248 (U.S. Pat. No. 6,974,863) or XmAb-5592, or from any one of the anti-CD137 antibodies described in WO2017/04945, WO2016/134358, WO2015/179236, WO2012/177788, WO2012/145183, WO2012/032433, WO2009/135019, WO2005/035584, U.S. Pat. No. 6,974,863, WO2004/055513 and WO2004/010947; the sequences and features of the anti-CD137 antibodies are incorporated herein by reference.

In one embodiment, the antigen-binding site specifically binds GITR, e.g. hGITR. In one embodiment, the GITR antigen-binding site comprises the CDRH1, CDRH2, CDRH3, CDRL1, CDRL2 and CDRL3, or the $V_H$, or the $V_L$ or the $V_H$ and $V_L$ region from MK4166, TRX518, TRX385, MAB689 (R & D Systems), YGITR765 (Novus Biologicals) or 1D8 (Novus Biologicals), or from any one of the anti-GITR antibodies described in WO2015/187835 (including 28F3, 3C3-1, 3C3-2, 2G6, 8A6, 9G7-1, 9G7-2, 14E3, 19H8-1, 19H8-2, 19D3, 18E10, and 6G10), WO2015/184099 (including 1042-7, 32-15, 1039-45, 1333-21, 231-1039-45, 231-32-15, Hum231 #1, Hum231 #2, m6C8, pab1964, to pab1973, pab1975 to pab1977, pab1979 to pab1981, pab1983, pab2159, pab2160, pab2161 and the antibodies in tables 1 and 2), WO2015/031667 (including antibodies Ab1 to Ab59 in table 1), WO2015/026684 (including an antibody with a CDR sequence of Seq ID 1-66), WO2013/039954 (including, 2155, 1718, 1649, 1362, 954, 827, 698, 706 and antibodies listed in Tables 1 & 3), WO2011/051726 (including antibodies containing CDRs a-f listed on page 17), WO2011/028683 (including antibodies 36E5, 61F6, 61G6, 3D6, 6H6, 1D8, 17F10, 35D8, 49A1, 9E5, 31H6 and antibodies from hybridomas PTA-9889, PTA-9890, PTA-9891, PTA-9892, PTA-9893, PTA-10286, PTA-10287, PTA-10288, PTA-10289, PTA-10290, and PTA-10291), WO2009/009116 (including antibody 2F8), WO2007/133822 (including antibodies listed in Table 1), WO2006/105021 (including 6C8, 2F8, HuN6C8-Agly, HuQ6C8-Gly, and HuQ6C8-Agly), WO2006/050172 & WO2004/084942 (including DTA-1), WO03/006058 (including anti-GITR/TNFRSF18 #AF524), WO2016/054638 (including mAb #1-81, #3-167, #5-139, #7-192, #10-116, #11-126, #12-46, #13-169, #14-182, #15-68 and #17-60), WO2016/196792 (including 6G10, 28F3, 19D3, 18E10, 3C3, 2G6, 8A6, 9G7, 14E3 and 19H8), WO2017/087678 (including 28F3, 19D3, 18E10, 3C3-1, 3C3-2, 2G6, 8A6, 9G7-1, 9G7-2, 14E3, 19H8-1, 19H8-2 and 6G10); the sequences and features of the anti-GITR antibodies are incorporated herein by reference.

In one embodiment, the antigen-binding site specifically binds OX40, e.g. hOX40. In one embodiment, the OX40 antigen-binding site comprises the CDRH1, CDRH2, CDRH3, CDRL1, CDRL2 and CDRL3, or the $V_H$, or the $V_L$ or the $V_H$ and $V_L$ region from GSK3174998, L106 BD (Pharmingen Product #340420), ACT35 (Santa Cruz Biotechnology, Catalog #20073), MOXR0916, MEDI-6469, MEDI-0562, 9B12 (Weinberg, A. D., et al, J Immunother 29, 575-585 (2006)), the humanised anti-OX40 Ab described in Morris et al, Mol Immunol. May 2007; 44(12):3112-3121, or from any one of the anti-OX40 antibodies described in WO2017/077085 (including SAP9, SAP28.2, SAP15.3, SAP29-50, SAP25-29 and SAP29-23 and humanised versions described in Examples 4 and 5), WO2017/063162 (including 03, 019, 021 and the affinity matured version in Example 5—Table 2, including 21 #H28H33, 21 #H65, 21 #H96, 21 #VHnew-L80, 21 #H96-L80), WO2017/050729 (including SP197), WO2017/021912 & WO2017/021910 (including ANTIBODY 106-222, OX86, and the antibodies described in FIGS. 6 and 7), WO2016/200836 & WO2016/200835 (including MOXR0916/1A7.gr1 IgG1), WO2016/196228 (including 3F4, 14B6-1, 14B6-2, 23H3, 18E9, 8B11, 20B3, 20C1, 6E1-1, 6E1-2, 14A2, 14A2-1, 14A2-2, L106, OX40.1, OX40.5, OX40.8, OX40.6, and OX40.16 and OX40.21—FIGS. 1 to 10), WO2016/179517 (including 11D4, pab1949, pab1949-1, pab2044, pab2193-1, Tables 1 to 4), WO2016/057667 (including 9B12 and OX40mAb24), WO2015/153513 (including 3C8, 1D2, 1A7 and their variants described in the sequence listing, including A1A7.gr1 and 3C8.gr.5, the antibodies described in FIG. 1), WO2014/148895 (including ACT35, 12H3, 12H3 (FIG. 25)—and humanised versions VL1H1, VL1VH2, VL1VH3, VL2H1, VL2VH2 and VL2VH3 (FIG. 43 & 44) and 20E5 (FIG. 24)), WO2013/068563 (including A26 [FIG. 2]), WO2013/038191 (including ACT35, 12H3 and 12H3), WO2013/028231 (including 119-122, 119-43-1, 106-222 and the antibodies in Table 1), WO2013/008171 (including 2F8, 1D4 and their derivatives, including VH6/VL9, and the antibodies in FIGS. 4 and 5 and tables 6 and 7), WO2012/027328 (including 119-122, 119-43-1, Hu106 and Hu106-222), WO2010/096418 (including A26), WO2008/106116 (including the antibodies in Tables 1 and 2, and A10 (inc A10A-F), B66—FIG. 14—B2, B24, B36, B37, and B39) and WO2007/062245 (including 112V8 (ATCC No. PTA-7219), 112Y55 (ATCC No. PTA-7220), 112Y131 (ATCC No. PTA-7218), 112F32 (ATCC No. PTA-7217) and 112Z5 (ATCC No. PTA-7216); the sequences and features of the anti-OX40 antibodies are incorporated herein by reference.

In one embodiment, the antigen-binding site specifically binds CXCR3, e.g. CXCR3. In one embodiment, the CXCR3 antigen-binding site comprises the CDRH1, CDRH2, CDRH3, CDRL1, CDRL2 and CDRL3, or the $V_H$, or the $V_L$ or the $V_H$ and $V_L$ region from GSK3174998 or from any one of the anti-CXCR3 antibodies described in WO2016/200836, WO2016/200835, WO2016/196228, WO2016/179517, WO2016/057667, WO2015/153513, WO2014/148895, WO2013/068563, WO2013/038191, WO2013/028231, WO2013/008171, WO2012/027328, WO2010/096418, WO2011/073180, WO2008/106116 and WO2007/062245; the sequences and features of the anti-CXCR3 antibodies are incorporated herein by reference.

In one embodiment, the antigen-binding site specifically binds CD27, e.g. hCD27. In one embodiment, the CD27 antigen-binding site comprises the CDRH1, CDRH2, CDRH3, CDRL1, CDRL2 and CDRL3, or the $V_H$, or the $V_L$ or the $V_H$ and $V_L$ region from any one of the anti-CD27 antibodies described in WO2016/145085 (including 1F5), WO2015/016718 (including hCD27.15 and 1F5), WO2014/140374 (including 2F2, 5F24, 5F32, 10F13, 10F31, 11F26, 1O52 to 015, F2A4B2 and their derivatives, including hz5F24VH+V5Q, hz5F24VL+K45Q), WO2013/138586 (including C2177, C2186, C2191, and C2192 and the derivatives in Examples 8 to 12, and tables 7 to 42), WO2012/004367 (including hCD27.15/ATCC number PTA-11008), WO2011/130434 (including 1G5, 1H8, 3H12, 3H8, 2G9, 1F5, 3A10, 2C2, ms 1A4, ms 9F4 and ms M-T271), WO2011/081164 & WO2010/001908 (including KM4027, KM4028, KM4026, KM4030, KM4032 and derivatives thereof), WO2008/051424 (including LG3A10 and AT124-1); the sequences and features of the anti-CD27 antibodies are incorporated herein by reference.

In one embodiment, the antigen-binding site specifically binds CD3, e.g. hCD3. In one embodiment, the CD3 antigen-binding site comprises the CDRH1, CDRH2, CDRH3, CDRL1, CDRL2 and CDRL3, or the $V_H$, or the $V_L$ or the $V_H$ and $V_L$ region from OKT3 antibody, otelixizumab, teplizumab or visilizumab, or from any one of the anti-CD3 antibodies described in WO2017/010874, WO2017/009442, WO2016/204966, WO2016/180721, WO2016/179003, WO2016/116626, WO2016/014974, WO2015/104346, WO2015/095392, WO2015/001085, WO2014/047231, WO2013/188693, WO2013/186613, WO2013/158856, WO2012/173819, WO2012/162067, WO2005/118635, WO2004/108158, WO2004/052397, WO2004/024771, WO01/51644, WO00/05268, WO97/44362, WO93/19196, WO92/06193 and WO91/09968; the sequences and features of the anti-CD3 antibodies are incorporated herein by reference.

Aspect 1b. An immunocytokine comprising an immunoglobulin heavy chain and an immunoglobulin light chain, wherein the heavy chain comprises in N- to C-terminal direction:
a) A $V_H$ domain comprising CDRH1, CDRH2 and CDRH3; and
b) A heavy chain constant region;
c) Optionally, a linker, (L); and
d) An IL-2 cytokine;
and wherein the light chain comprises in N- to C-terminal direction:
e) A $V_L$ domain comprising CDRL1, CDRL2 and CDRL3; and
f) A light chain constant region, ($C_L$);
wherein the $V_H$ domain and $V_L$ domain are comprised by an antigen-binding site that specifically binds to an antigen selected from: an immune checkpoint inhibitor (such as PD-1, CTLA-4, TIGIT, TIM-3, LAG-3 and VISTA, e.g. TIGIT, TIM-3 and LAG-3), an immune modulator (such as BTLA, hHVEM, CSF1R, CCR4, CD39, CD40, CD73, CD96, CXCR2, CXCR4, CD200, GARP, SIRPα, CXCL9, CXCL10 and CD155, e.g. GARP, SIRPα, CXCR4, BTLA, hVEM and CSF1R), and an immune activator (such as CD137, GITR, OX40, CD40, CXCR3 (e.g. agonistic anti-CXCR3 antibodies), CD27, CD3 and ICOS (e.g. agonistic anti-ICOS antibodies), for example ICOS, CD137, GITR and OX40).

In another embodiment, the antigen-binding site that specifically binds to an antigen selected from: an immune checkpoint inhibitor (such as PD-1, CTLA-4, TIGIT, TIM-3, LAG-3 and VISTA, e.g. TIGIT, TIM-3 and LAG-3), an immune modulator (such as BTLA, hHVEM, CSF1R, CCR4, CD39, CD40, CD73, CD96, CXCR2, CXCR4, CD200, GARP, SIRPα, CXCL9, CXCL10 and CD155, e.g. GARP, SIRPα, CXCR4, BTLA, hVEM and CSF1R), and an immune activator (such as CD137, GITR, OX40, CD40, CXCR3 (e.g. agonistic anti-CXCR3 antibodies), CD3 and ICOS (e.g. agonistic anti-ICOS antibodies), for example ICOS, CD137, GITR and OX40).

Any of the embodiments of aspect 1 and/or aspect 1a apply mutatis mutandis to aspect 1b. Any of the features or embodiments of aspects 2 to 54 apply mutatis mutandis to aspect 1b. Any of the features of the antibodies or other embodiments or features of concepts 1 to 70 apply mutatis mutandis to aspect 1b.

In one embodiment, the antigen binding site specifically binds any of the antigens as set out in aspect 1a.

In one embodiment, the antigen-binding site specifically bind to hPD-L1 as defined by Seq ID No:1, and competes for binding to said hPD-L1 with the antibody 1D05; and wherein the immunocytokine comprises a $V_H$ domain which comprises a CDRH3 comprising the motif X1GSGX2YGX3X4FD (SEQ ID NO: 753), wherein $X_1$, $X_2$ and $X_3$ are independently any amino acid, and $X_4$ is either present or absent, and if present, may be any amino acid.

In either of aspect 1 or 1a, the wording of part f) may be substituted to read: "f) a cytokine, e.g. selected from IL-7, IL-15, IL-21, IL-12, GM-CSF, TNFα, TGFβ, CXCL9, CXCL10 and interferon-α". In 1b, the wording of part d) may be substituted for "d) a cytokine, e.g. selected from IL-7, IL-15, IL-21, IL-12, GM-CSF, TNFα, TGFβ, CXCL9, CXCL10 and interferon-α". Thus, the immunocytokines as disclosed herein may contain cytokines other than a cytokine having IL-2 cytokine activity. In one embodiment, the cytokine is IL-7 (Seq ID No:330). In one embodiment, the cytokine is IL-15 (Seq ID No:331). In one embodiment, the cytokine is IL-21 (Seq ID No:332). In one embodiment, the cytokine is IL-12, comprising the α-chain (Seq ID No:336) and the β-chain (Seq ID No:337). In one embodiment, the cytokine is GM-CSF (Seq ID No:333). In one embodiment, the cytokine is TNFα (Seq ID No:335). In one embodiment, the cytokine is TGFβ. In one embodiment, the cytokine is CXCL9 (Seq ID No:338). In one embodiment, the cytokine is CXCL10 (Seq ID No:339). In one embodiment, the cytokine is interferon-α, (Seq ID No:334).

In another embodiment, the cytokine is an immune-stimulating cytokine. In another embodiment, the cytokine is a T-cell stimulating cytokine.

Aspect 2. An immunocytokine according to aspect 1, wherein $X_1$ is a hydroxyl-containing amino acid, optionally T.

Aspect 3. An immunocytokine according to aspect 1 or aspect 2, wherein $X_2$ is a basic amino acid, optionally K.

Aspect 4. An immunocytokine according to any one of aspects 1 to 3, wherein $X_2$ is a hydroxyl-containing amino acid, optionally S or T.

Aspect 5. The immunocytokine according to any one of claims 1 to 4, wherein $X_3$ is an aromatic amino acid, optionally W.

Aspect 6. An immunocytokine according to any one of aspects 1 to 5, wherein $X_4$ is absent.

Aspect 7. An immunocytokine according to any one of aspects 1 to 5, wherein $X_4$ is present.

Aspect 8. An immunocytokine according to aspect 7, wherein $X_4$ is an aliphatic amino acid, optionally G.

The features of aspects 2 to 7 may be as defined in any of concepts 2 to 7 hereinabove.

Aspect 9. An immunocytokine comprising an immunoglobulin heavy chain and an immunoglobulin light chain, wherein the heavy chain comprises in N- to C-terminal direction:
a) A $V_H$ domain comprising CDRH1, CDRH2 and CDRH3; and
b) A heavy chain constant region;
and wherein the light chain comprises in N- to C-terminal direction:
c) A $V_L$ domain comprising CDRL1, CDRL2 and CDRL3;
d) A light chain constant region, ($C_L$);
e) Optionally, a linker, (L); and
f) An IL-2 cytokine;
wherein the $V_H$ domain and $V_L$ domain are comprised by an antigen-binding site that specifically binds to hPD-L1, and competes for binding to said hPD-L1 with the antibody 1D05, wherein the antibody or fragment comprises a $V_H$ domain which comprises the CDRH3 sequence of SEQ ID NO:29 or 32, or the CDRH3 sequence of SEQ ID NO:29 or 32 comprising 6 or fewer amino acid substitutions, optionally, wherein the immunocytokine is according to any one of aspects 2 to 8.

In this aspect, any of the features of CDRH3 described in concepts 9, and 9a to 1, and any of the embodiments of concept 9 apply mutatis mutandis.

Aspect 10. An immunocytokine comprising an immunoglobulin heavy chain and an immunoglobulin light chain, wherein the heavy chain comprises in N- to C-terminal direction:
a) A $V_H$ domain comprising CDRH1, CDRH2 and CDRH3; and
b) A heavy chain constant region;
and wherein the light chain comprises in N- to C-terminal direction:
c) A $V_L$ domain comprising CDRL1, CDRL2 and CDRL3;
d) A light chain constant region, ($C_L$);
e) Optionally, a linker, (L); and
f) An IL-2 cytokine;
wherein the $V_H$ domain and $V_L$ domain are comprised by an antigen-binding site that specifically binds to hPD-L1; and
wherein the $V_H$ domain comprises a CDRH3 of from 12 to 20 amino acids and which is derived from the recombination of a human $V_H$ gene segment, a human D gene segment and a human $J_H$ gene segment, wherein the human $J_H$ gene segment is IGHJ5 (e.g. IGHJ5*02).

In this aspect, any of the features of CDRH3 described in concepts 10 and 10a apply mutatis mutandis.

Aspect 11. An immunocytokine according to aspect 10, wherein the human $V_H$ gene segment is IGHV3 (e.g. IGHV3-9, such as IGHV3-9*01).

In this aspect, any of the features of the gene segments described in concept 11, 11a or 11b apply mutatis mutandis.

Aspect 12. An immunocytokine according to aspect 10 or aspect 11, wherein the antibody or fragment comprises a $V_L$ domain which is derived from the recombination of a human Vκ gene segment, and a human Jκ gene segment, wherein the human $V_L$ gene segment is IGκV1D (e.g. IGκV1D-39, such as IGκV1D-39*01).

In this aspect, any of the features of the gene segments described in concept 12, 12a or 12b apply mutatis mutandis.

Aspect 13. An immunocytokine comprising an immunoglobulin heavy chain and an immunoglobulin light chain, wherein the heavy chain comprises in N- to C-terminal direction:
a) A $V_H$ domain comprising CDRH1, CDRH2 and CDRH3; and
b) A heavy chain constant region;
and wherein the light chain comprises in N- to C-terminal direction:
c) A $V_L$ domain comprising CDRL1, CDRL2 and CDRL3;
d) A light chain constant region, ($C_L$);
e) Optionally, a linker, (L); and
f) An IL-2 cytokine;
wherein the $V_H$ domain and $V_L$ domain are comprised by an antigen-binding site that specifically binds to an epitope that is identical to an epitope to which the antibody 1D05 specifically binds.

In this aspect, any of the features of the epitopes, assays and other embodiments described in any of concepts 13 and 13a to 13l apply mutatis mutandis.

Aspect 14. An immunocytokine according to aspect 13, wherein the epitope is identified by an unrelated amino acid scan, or by X-ray crystallography.

Aspect 15. An immunocytokine according to aspect 14, wherein the contact residues of the epitope are defined by a reduction in affinity of at least 10-fold in an unrelated amino acid scan, e.g. an alanine scan as determined by SPR.

In this aspect, any of the features of concept 15 apply mutatis mutandis.

Aspect 16. An immunocytokine comprising an immunoglobulin heavy chain and an immunoglobulin light chain, wherein the heavy chain comprises in N- to C-terminal direction:
a) A $V_H$ domain comprising CDRH1, CDRH2 and CDRH3; and
b) A heavy chain constant region;
and wherein the light chain comprises in N- to C-terminal direction:
c) A $V_L$ domain comprising CDRL1, CDRL2 and CDRL3;
d) A light chain constant region, ($C_L$);
e) Optionally, a linker, (L); and
f) An IL-2 cytokine;

wherein the $V_H$ domain and $V_L$ domain are comprised by an antigen-binding site which competes for binding to hPD-L1 with the antibody 1D05.

In this aspect, any of the features of the antibodies of concepts 16a to 16l or any of the competitive assays and other embodiments described in concept 16, or the features of concept 35 apply mutatis mutandis.

Aspect 17. An immunocytokine according to any one of aspects 10 to 16, wherein the $V_H$ domain comprises the CDRH3 sequence of SEQ ID NO:29 or 32, or the CDRH3 sequence of SEQ ID NO:29 or 32 comprising 6 or fewer amino acid substitutions.

In this aspect, any of the features of the antibodies of concepts 17a to 17l apply mutatis mutandis.

Aspect 18. An immunocytokine according to any preceding aspect, wherein the $V_H$ domain comprises the CDRH1 sequence of SEQ ID NO:27 or 30 or the CDRH1 sequence of SEQ ID NO:27 or 30 comprising 3, 2 or 1 amino acid substitution(s).

In this aspect, any of the features of the antibodies of concepts 18a to 18l apply mutatis mutandis.

Aspect 19. An immunocytokine according to any preceding aspect, wherein the $V_H$ domain comprises the CDRH2 sequence of SEQ ID NO:28 or 31, or the CDRH2 sequence of SEQ ID NO:28 or 31 comprising 4 or fewer amino acid substitutions.

In this aspect, any of the features of the antibodies of concepts 19a to 19l apply mutatis mutandis.

Aspect 20. An immunocytokine according to any preceding aspect, wherein the $V_H$ domain comprises an amino acid sequence of SEQ ID NO:33, or a heavy chain variable domain amino acid sequence that is at least 80% (e.g. at least 85%, or at least 90%) identical to SEQ ID NO:33 (for example the $V_H$ domain sequence in any of the heavy chain sequences of Seq ID Nos:47 to 49).

In this aspect, any of the features of the antibodies of concepts 20a to 20l or any of the embodiments of concept 20 apply mutatis mutandis.

Aspect 21. An immunocytokine according to any preceding aspect comprising first and second copies of said heavy chain.

Aspect 22. An immunocytokine according to any preceding aspect, comprising a $V_L$ domain which comprises the CDRL1 sequence of SEQ ID NO:37 or 40, or the CRDL1 sequence of SEQ ID NO:37 or 40 comprising 3 or fewer amino acid substitutions.

In this aspect, any of the features of the antibodies of concepts 22a to 22l apply mutatis mutandis.

Aspect 23. An immunocytokine according to any preceding aspect, comprising a $V_L$ domain which comprises the CDRL2 sequence of SEQ ID NO:38 or 41, or the CRDL2 sequence of SEQ ID NO:38 or 41 comprising 2 or 1 amino acid substitution(s), for example a CDRL2 sequence of Seq ID No:50.

In this aspect, any of the features of the antibodies of concepts 23a to 23l apply mutatis mutandis.

Aspect 24. An immunocytokine according to any preceding aspect, comprising a $V_L$ domain which comprises the CDRL3 sequence of SEQ ID NO:39 or 42, or the CRDL3 sequence of SEQ ID NO:39 or 42 comprising 4 or fewer amino acid substitutions.

In this aspect, any of the features of the antibodies of concepts 24a to 24l apply mutatis mutandis.

Aspect 25. An immunocytokine according to any preceding aspect, comprising a $V_L$ domain which comprises an amino acid sequence of SEQ ID NO:43, or a light chain variable domain amino acid sequence that is at least 80% (e.g. at least 85%, or at least 90%) identical to SEQ ID NO:43 (for example the $V_L$ domain sequence in the light chain sequence of Seq ID No:50 or 51).

In this aspect, any of the features of the antibodies of concepts 25a to 25l or any of the embodiments of concept 25 apply mutatis mutandis.

Aspect 26. An immunocytokine according to any preceding aspect comprising first and second copies of said light chain.

Aspect 27. An immunocytokine according to any preceding aspect which specifically binds to cynomolgus PD-L1 as defined by Seq ID No:2.

In this aspect, any of embodiments of concept 27 apply mutatis mutandis.

Aspect 28. An immunocytokine according to any preceding aspect, wherein the antibody or fragment comprises a kappa light chain.

In this aspect, any of the embodiments of concept 28 apply mutatis mutandis.

Aspect 29. An immunocytokine according to any one of aspects 9 to 28, wherein the amino acid substitutions are conservative amino acid substitutions, optionally wherein the conservative substitutions are from one of six groups (each group containing amino acids that are conservative substitutions for one another) selected from:
  1) Alanine (A), Serine (S), Threonine (T);
  2) Aspartic acid (D), Glutamic acid (E);
  3) Asparagine (N), Glutamine (Q);
  4) Arginine (R), Lysine (K);
  5) Isoleucine (I), Leucine (L), Methionine (M), Valine (V); and
  6) Phenylalanine (F), Tyrosine (Y), Tryptophan (W).

In this aspect, any of the embodiments of concept 9 apply mutatis mutandis.

Aspect 30. An immunocytokine according to any preceding aspect, wherein the antibody or fragment comprises a constant region, e.g. an IgG1 constant region, optionally wherein the constant region is a disabled IgG1 as defined in Seq ID No:205.

In this aspect, any of the features or the embodiments of concepts 30, 31 or 32 apply mutatis mutandis.

Aspect 31. An immunocytokine according to any preceding aspect wherein the:
  A) $V_H$ domain comprises an amino acid sequence of SEQ ID No:33 and the $V_L$ domain comprises an amino acid sequence of SEQ ID No:43;
  B) $V_H$ domain comprises an amino acid sequence that is at least 85% identical to SEQ ID No:33, and the $V_L$ domain comprises an amino acid sequence that is at least 85% identical to SEQ ID No:43;
  C) $V_H$ domain comprises an amino acid sequence of the $V_H$ domain of SEQ ID No:47 and the $V_L$ domain comprises an amino acid sequence of SEQ ID No:43;
  D) $V_H$ domain comprises an amino acid sequence of the $V_H$ domain of SEQ ID No:48 and the $V_L$ domain comprises an amino acid sequence of SEQ ID No:43;
  E) $V_H$ domain comprises an amino acid sequence of the $V_H$ domain of SEQ ID No:49 and the $V_L$ domain comprises an amino acid sequence of SEQ ID No:43;
  F) $V_H$ domain comprises an amino acid sequence of SEQ ID No:33 and the $V_L$ domain comprises an amino acid sequence of the $V_L$ domain of SEQ ID No:50;
  G) $V_H$ domain comprises an amino acid sequence of the $V_H$ domain of SEQ ID No:47 and the $V_L$ domain comprises an amino acid sequence of the $V_L$ domain of SEQ ID No:50;

H) V_H domain comprises an amino acid sequence of the V_H domain of SEQ ID No:48 and the V_L domain comprises an amino acid sequence of the V_L domain of SEQ ID No:50;
I) V_H domain comprises an amino acid sequence of the V_H domain of SEQ ID No:49 and the V_L domain comprises an amino acid sequence of the V_L domain of SEQ ID No:50;
J) V_H domain comprises an amino acid sequence of SEQ ID No:33 and the V_L domain comprises an amino acid sequence of the V_L domain of SEQ ID No:51;
K) V_H domain comprises an amino acid sequence of the V_H domain of SEQ ID No:47 and the V_L domain comprises an amino acid sequence of the V_L domain of SEQ ID No:51;
L) V_H domain comprises an amino acid sequence of the V_H domain of SEQ ID No:48 and the V_L domain comprises an amino acid sequence of the V_L domain of SEQ ID No:51;
M) V_H domain comprise an amino acid sequence of the V_H domain of SEQ ID No:49 and the V_L domain comprises an amino acid sequence of the V_L domain of SEQ ID No:51;
N) V_H domain comprises an amino acid sequence of SEQ ID No:33 and the V_L domain comprises an amino acid sequence of the V_L domain of SEQ ID No:298;
O) V_H domain comprises an amino acid sequence of the V_H domain of SEQ ID No:47 and the V_L domain comprises an amino acid sequence of the V_L domain of SEQ ID No:298;
P) V_H domain comprises an amino acid sequence of the V_H domain of SEQ ID No:48 and the V_L domain comprises an amino acid sequence of the V_L domain of SEQ ID No:298;
Q) V_H domain comprise an amino acid sequence of the V_H domain of SEQ ID No:49 and the V_L domain comprises an amino acid sequence of the V_L domain of SEQ ID No:298;
R) V_H domain comprises an amino acid sequence of SEQ ID No:58 and the V_L domain comprises an amino acid sequence of SEQ ID No:68;
S) V_H domain comprises an amino acid sequence that is at least 85% identical to SEQ ID No:58, and the V_L domain comprise an amino acid sequence that is at least 85% identical to SEQ ID No:68;
T) V_H domain comprises an amino acid sequence of SEQ ID No:78 and the V_L domain comprises an amino acid sequence of SEQ ID No:88;
U) V_H domain comprises an amino acid sequence that is at least 85% identical to SEQ ID No:78, and the V_L domain comprises an amino acid sequence that is at least 85% identical to SEQ ID No:88;
V) V_H domain comprises an amino acid sequence of SEQ ID No:98 and the V_L domain comprises an amino acid sequence of SEQ ID No:108;
W) V_H domain comprises an amino acid sequence that is at least 85% identical to SEQ ID No:98, and the V_L domain comprises an amino acid sequence that is at least 85% identical to SEQ ID No:108;
X) V_H domain comprises an amino acid sequence of SEQ ID No:118 and the V_L domain comprises an amino acid sequence of SEQ ID No:128;
Y) V_H domain comprises an amino acid sequence that is at least 85% identical to SEQ ID No:118, and the V_L domain comprises an amino acid sequence that is at least 85% identical to SEQ ID No:128;
Z) V_H domain comprises an amino acid sequence of SEQ ID No:158 and the V_L domain comprises an amino acid sequence of SEQ ID No:168;
AA) V_H domain comprises an amino acid sequence that is at least 85% identical to SEQ ID No:158, and the V_L domain comprises an amino acid sequence that is at least 85% identical to SEQ ID No:168;
BB) V_H domain comprises an amino acid sequence of SEQ ID No:178 and the V_L domain comprises an amino acid sequence of SEQ ID No:188;
CC) V_H domain comprises an amino acid sequence that is at least 85% identical to SEQ ID No:178, and the V_L domain comprises an amino acid sequence that is at least 85% identical to SEQ ID No:188;
DD) V_H domain comprises an amino acid sequence of SEQ ID No:138 and the V_L domain comprises an amino acid sequence of SEQ ID No:148;
EE) V_H domain comprises an amino acid sequence that is at least 85% identical to SEQ ID No:13, and the V_L domain comprises an amino acid sequence that is at least 85% identical to SEQ ID No:148;
FF) V_H domain comprises an amino acid sequence of SEQ ID No:244 and the V_L domain comprises an amino acid sequence of SEQ ID No:254;
GG) V_H domain comprises an amino acid sequence that is at least 85% identical to SEQ ID No:244, and the V_L domain comprises an amino acid sequence that is at least 85% identical to SEQ ID No:254;
HH) V_H domain comprises an amino acid sequence of SEQ ID No:264 and the V_L domain comprises an amino acid sequence of SEQ ID No:274;
II) V_H domain comprises an amino acid sequence that is at least 85% identical to SEQ ID No:264, and the V_L domain comprises an amino acid sequence that is at least 85% identical to SEQ ID No:274;
JJ) V_H domain comprises an amino acid sequence of SEQ ID No:284 and the V_L domain comprises an amino acid sequence of SEQ ID No:294;
KK) V_H domain comprises an amino acid sequence that is at least 85% identical to SEQ ID No:284, and the V_L domain comprises an amino acid sequence that is at least 85% identical to SEQ ID No:294;
LL) V_H domain comprises an amino acid sequence of SEQ ID No:13 and the V_L domain comprises an amino acid sequence of SEQ ID No:23; and
MM) V_H domain comprises an amino acid sequence that is at least 85% identical to SEQ ID No:13, and the V_L domain comprises an amino acid sequence that is at least 85% identical to SEQ ID No:23;
NN) V_H domain comprises an amino acid sequence of SEQ ID No:349 and the V_L domain comprises an amino acid sequence of SEQ ID No:359; and
OO) V_H domain comprises an amino acid sequence that is at least 85% identical to SEQ ID No:349, and the V_L domain comprises an amino acid sequence that is at least 85% identical to SEQ ID No:359.

In one embodiment, the amino acid sequence is at least 70% identical to the specified Seq ID No. In one embodiment, the amino acid sequence is at least 75% identical to the specified Seq ID No. In one embodiment, the amino acid sequence is at least 95% identical to the specified Seq ID No. In one embodiment, the amino acid sequence is at least 96% identical to the specified Seq ID No. In one embodiment, the amino acid sequence is at least 97% identical to the specified Seq ID No. In one embodiment, the amino acid sequence is at least 98% identical to the specified Seq ID No. In one embodiment, the amino acid sequence is at least 99% identical to the specified Seq ID No. In one embodiment, the amino acid sequence is at least 99.5% identical to the specified Seq ID No.

Aspect 32. An immunocytokine according to any preceding aspect wherein the:

A) $V_H$ and the constant region comprise an amino acid sequence of SEQ ID No:299 and $V_L$ and $C_L$ comprise an amino acid sequence of SEQ ID No:45;
B) $V_H$ and the constant region comprise an amino acid sequence that is at least 85% identical to SEQ ID No:299, and the $V_L$ and $C_L$ comprise an amino acid sequence that is at least 85% identical to SEQ ID No:45;
C) $V_H$ and the constant region comprise an amino acid sequence of SEQ ID No:47 and $V_L$ and $C_L$ comprise an amino acid sequence of SEQ ID No:45;
D) $V_H$ and the constant region comprise an amino acid sequence of SEQ ID No:48 and $V_L$ and $C_L$ comprise an amino acid sequence of SEQ ID No:45;
E) $V_H$ and the constant region comprise an amino acid sequence of SEQ ID No:49 and $V_L$ and $C_L$ comprise an amino acid sequence of SEQ ID No:45;
F) $V_H$ and the constant region comprise an amino acid sequence of SEQ ID No:342 and $V_L$ and $C_L$ comprise an amino acid sequence of SEQ ID No:45;
G) $V_H$ and the constant region comprise an amino acid sequence of SEQ ID No:238 and $V_L$ and $C_L$ comprise an amino acid sequence of SEQ ID No:50;
H) $V_H$ and the constant region comprise an amino acid sequence of SEQ ID No:47 and $V_L$ and $C_L$ comprise an amino acid sequence of SEQ ID No:50;
I) $V_H$ and the constant region comprise an amino acid sequence of SEQ ID No:48 and $V_L$ and $C_L$ comprise an amino acid sequence of SEQ ID No:50;
J) $V_H$ and the constant region comprise an amino acid sequence of SEQ ID No:49 and $V_L$ and $C_L$ comprise an amino acid sequence of SEQ ID No:50;
K) $V_H$ and the constant region comprise an amino acid sequence of SEQ ID No:342 and $V_L$ and $C_L$ comprise an amino acid sequence of SEQ ID No:50;
L) $V_H$ and the constant region comprise an amino acid sequence of SEQ ID No:299 and $V_L$ and $C_L$ comprise an amino acid sequence of SEQ ID No:51;
M) $V_H$ and the constant region comprise an amino acid sequence of SEQ ID No:47 and $V_L$ and $C_L$ comprise an amino acid sequence of SEQ ID No:51;
N) $V_H$ and the constant region comprise an amino acid sequence of SEQ ID No:48 and $V_L$ and $C_L$ comprise an amino acid sequence of SEQ ID No:51;
O) $V_H$ and the constant region comprise an amino acid sequence of SEQ ID No:49 and $V_L$ and $C_L$ comprise an amino acid sequence of SEQ ID No:51;
P) $V_H$ and the constant region comprise an amino acid sequence of SEQ ID No:342 and $V_L$ and $C_L$ comprise an amino acid sequence of SEQ ID No:51;
Q) $V_H$ and the constant region comprise an amino acid sequence of SEQ ID No:299 and $V_L$ and $C_L$ comprise an amino acid sequence of SEQ ID No:298;
R) $V_H$ and the constant region comprise an amino acid sequence of SEQ ID No:47 and $V_L$ and $C_L$ comprise an amino acid sequence of SEQ ID No:298;
S) $V_H$ and the constant region comprise an amino acid sequence of SEQ ID No:48 and $V_L$ and $C_L$ comprise an amino acid sequence of SEQ ID No:298;
T) $V_H$ and the constant region comprise an amino acid sequence of SEQ ID No:49 and $V_L$ and $C_L$ comprise an amino acid sequence of SEQ ID No:298;
U) $V_H$ and the constant region comprise an amino acid sequence of SEQ ID No:342 and $V_L$ and $C_L$ comprise an amino acid sequence of SEQ ID No:298;
V) $V_H$ and the constant region comprise an amino acid sequence of SEQ ID No:60 and $V_L$ and $C_L$ comprise an amino acid sequence of SEQ ID No:70;
W) $V_H$ and the constant region comprise an amino acid sequence that is at least 85% identical to SEQ ID No:60, and the $V_L$ and $C_L$ comprise an amino acid sequence that is at least 85% identical to SEQ ID No:70;
X) $V_H$ and the constant region comprise an amino acid sequence of SEQ ID No:80 and $V_L$ and $C_L$ comprise an amino acid sequence of SEQ ID No:90;
Y) $V_H$ and the constant region comprise an amino acid sequence that is at least 85% identical to SEQ ID No:80, and the $V_L$ and $C_L$ comprise an amino acid sequence that is at least 85% identical to SEQ ID No:90;
Z) $V_H$ and the constant region comprise an amino acid sequence of SEQ ID No:100 and $V_L$ and $C_L$ comprise an amino acid sequence of SEQ ID No:110;
AA) $V_H$ and the constant region comprise an amino acid sequence that is at least 85% identical to SEQ ID No:100, and the $V_L$ and $C_L$ comprise an amino acid sequence that is at least 85% identical to SEQ ID No:110;
BB) $V_H$ and the constant region comprise an amino acid sequence of SEQ ID No:120 and $V_L$ and $C_L$ comprise an amino acid sequence of SEQ ID No:130;
CC) $V_H$ and the constant region comprise an amino acid sequence that is at least 85% identical to SEQ ID No:120, and the $V_L$ and $C_L$ comprise an amino acid sequence that is at least 85% identical to SEQ ID No:130;
DD) $V_H$ and the constant region comprise an amino acid sequence of SEQ ID No:160 and $V_L$ and $C_L$ comprise an amino acid sequence of SEQ ID No:170;
EE) $V_H$ and the constant region comprise an amino acid sequence that is at least 85% identical to SEQ ID No:160, and the $V_L$ and $C_L$ comprise an amino acid sequence that is at least 85% identical to SEQ ID No:170;
FF) $V_H$ and the constant region comprise an amino acid sequence of SEQ ID No:180 and $V_L$ and $C_L$ comprise an amino acid sequence of SEQ ID No:190;
GG) $V_H$ and the constant region comprise an amino acid sequence that is at least 85% identical to SEQ ID No:180, and the $V_L$ and $C_L$ comprise an amino acid sequence that is at least 85% identical to SEQ ID No:190;
HH) $V_H$ and the constant region comprise an amino acid sequence of SEQ ID No:140 and $V_L$ and $C_L$ comprise an amino acid sequence of SEQ ID No:150;
II) $V_H$ and the constant region comprise an amino acid sequence that is at least 85% identical to SEQ ID No:140, and the $V_L$ and $C_L$ comprise an amino acid sequence that is at least 85% identical to SEQ ID No:150;
JJ) $V_H$ and the constant region comprise an amino acid sequence of SEQ ID No:246 and $V_L$ and $C_L$ comprise an amino acid sequence of SEQ ID No:256;
KK) $V_H$ and the constant region comprise an amino acid sequence that is at least 85% identical to SEQ ID No:246, and the $V_L$ and $C_L$ comprise an amino acid sequence that is at least 85% identical to SEQ ID No:256;

LL) $V_H$ and the constant region comprise an amino acid sequence of SEQ ID No:266 and $V_L$ and $C_L$ comprise an amino acid sequence of SEQ ID No:276;

MM) $V_H$ and the constant region comprise an amino acid sequence that is at least 85% identical to SEQ ID No:266, and the $V_L$ and $C_L$ comprise an amino acid sequence that is at least 85% identical to SEQ ID No:276;

NN) $V_H$ and the constant region comprise an amino acid sequence of SEQ ID No:286 and $V_L$ and $C_L$ comprise an amino acid sequence of SEQ ID No:296; and OO) $V_H$ and the constant region comprise an amino acid sequence that is at least 85% identical to SEQ ID No:286, and the $V_L$ and $C_L$ comprise an amino acid sequence that is at least 85% identical to SEQ ID No:296;

PP) $V_H$ and the constant region comprise an amino acid sequence of SEQ ID No:15 and $V_L$ and $C_L$ comprise an amino acid sequence of SEQ ID No:25; and QQ) $V_H$ and the constant region comprise an amino acid sequence that is at least 85% identical to SEQ ID No:15, and the $V_L$ and $C_L$ comprise an amino acid sequence that is at least 85% identical to SEQ ID No:25;

RR) $V_H$ and the constant region comprise an amino acid sequence of SEQ ID No:351 and $V_L$ and $C_L$ comprise an amino acid sequence of SEQ ID No:361; and SS) $V_H$ and the constant region comprise an amino acid sequence that is at least 85% identical to SEQ ID No:351, and the $V_L$ and $C_L$ comprise an amino acid sequence that is at least 85% identical to SEQ ID No:361.

In one embodiment, the amino acid sequence is at least 70% identical to the specified Seq ID No. In one embodiment, the amino acid sequence is at least 75% identical to the specified Seq ID No. In one embodiment, the amino acid sequence is at least 95% identical to the specified Seq ID No. In one embodiment, the amino acid sequence is at least 96% identical to the specified Seq ID No. In one embodiment, the amino acid sequence is at least 97% identical to the specified Seq ID No. In one embodiment, the amino acid sequence is at least 98% identical to the specified Seq ID No. In one embodiment, the amino acid sequence is at least 99% identical to the specified Seq ID No. In one embodiment, the amino acid sequence is at least 99.5% identical to the specified Seq ID No.

Aspect 33. An immunocytokine according to any preceding aspect wherein the antigen-binding site specifically binds PD-L1, whilst the IL-2 cytokine binds the high affinity ($\alpha\beta\gamma$) IL-2 receptor (IL-2R).

In one embodiment, the antigen binding site binds PD-L1 simultaneously to the IL-2 cytokine binding the $\alpha\beta\gamma$ IL-2R. In one embodiment, the antigen binding site binds PD-L1 sequentially to the IL-2 cytokine binding the $\alpha\beta\gamma$ IL-2R. In one embodiment, the IL-2 cytokine additionally binds the intermediate ($\beta\gamma$) IL-2R.

Aspect 34. An immunocytokine according to any preceding aspect wherein the immunocytokine is capable of inhibiting PD-L1-mediated suppression of T-cells.

In one embodiment, the immunocytokine inhibits PD-L1-mediated suppression of T-cells. In one embodiment, the immunocytokine inhibits PD-L1-mediated suppression of T-cells in an in vitro assay. In another embodiment, the antigen binding site has any of the features or embodiments of concept 51 or 52.

In another embodiment, the antigen binding site blocks or inhibits PD-1 binding to PD-L1. In one embodiment, the antigen binding site blocks or inhibits CD80 binding to PD-L1.

Aspect 35. An immunocytokine according to any preceding aspect wherein the immunocytokine is capable of increasing IL-2R-mediated T-cell activation.

In one embodiment, the immunocytokine increases IL-2R-mediated T-cell activation. In one embodiment, the immunocytokine increases IL-2R-mediated T-cell activation in an in vitro assay.

Aspect 36. An immunocytokine according to aspect 34 or aspect 35, wherein the suppression of T-cells or the increase in IL-2R-mediated T-cell activation is measured by an increase in one or more of IFNγ, IL-2, CD25 or proliferation of T-cells in an assay that provides co-stimulation by either direct CD3/CD28 stimulation, superantigen stimulation or provides co-stimulation by co-incubation with cells capable of inducing a T-cell response.

The measurements may be carried out with any suitable technique. For example, the measurements may be taken with ELISA, HTRF, BRDU incorporation (proliferation), electrochemiluminescence (ECL) or flow cytometry (e.g. FACS). These techniques are well-known to those skilled in the art and are described elsewhere herein. In one embodiment, the assay is flow cytometry. In one embodiment, the assay is ELISA. In one embodiment, the assay is HTRF.

In this aspect, when aspect 36 is dependent on aspect 34, any of the features or embodiments of concept 36 apply mutatis mutandis.

When Aspect 36 is dependent on Aspect 35, in one embodiment, the increase in IL-2R-mediated T-cell activation is measured by an increase in one or both of IFNγ and CD25.

When Aspect 36 is dependent on Aspect 35, in one embodiment, the co-stimulation is provided by direct CD3/CD28 stimulation.

When Aspect 36 is dependent on Aspect 35, in one embodiment, the co-stimulation is provided by a superantigen, such as staphylococcal enterotoxin B (SEB).

When Aspect 36 is dependent on Aspect 35, in one embodiment, the assay provides co-stimulation by co-incubation with cells capable of inducing a T-cell response. Such cells may be antigen-presenting cells (APCs), for example monocytes, B-cells or dendritic cells. In one embodiment, the assay provides co-stimulation by co-incubation with APCs. In one embodiment, the assay provides co-stimulation by co-incubation with monocytes. In one embodiment, the assay provides co-stimulation by co-incubation with B-cells. In one embodiment, the assay provides co-stimulation by co-incubation with dendritic cells.

Aspect 37. An immunocytokine according to any preceding aspect which does not comprise a linker (L), or an immunocytokine according to any preceding claim wherein the $C_L$ of d) is directly fused to the cytokine of f).

In one embodiment, the $C_L$ of the light chain or the heavy chain is directly fused to the cytokine.

In one embodiment of aspect 1b, the $C_L$ of b) is directly fused to the cytokine of d).

Aspect 38. An immunocytokine according to any one of aspects 1 to 37, wherein the linker is a peptide linker of 1 to 20 amino acids in length.

In one embodiment, the linker is peptide linker of 1 to 15 amino acids in length. In one embodiment, the linker is peptide linker of 1 to 10 amino acids in length. In one embodiment, the linker is peptide linker of 1 to 5 amino acids in length.

In one embodiment, the linker may be a chemical linker. In the case of recombinant fusion proteins, the linkers are encoded by nucleic acid sequences located in frame, in between the coding regions for the different immunocytokine portions. In the case of synthetic proteins, the linker peptides are introduced during synthesis.

Linkers are well-known to those skilled in the art. For example, see described in Denardo et al, 1998, Clin. Cancer Res., 4(10):2483-90; Peterson et al, 1999, Bioconjug. Chem. 10(4):553-7; and Zimmerman et al., 1999, Nucl. Med. Biol., 26(8):943-50, the modifications described therein are incorporated herein by reference.

Aspect 39. An immunocytokine according to aspect 38, wherein the linker peptide is selected from poly-G or $(G4S)_x$, wherein X is 1, 2, 3 or 4.

In other embodiments, the linker may be selected from STG, GSTG, RS, TVAAPS, GGGGS, GSTVAAPS, TVAAPSGS or GSTVAAPSGS. In another embodiment, the linker is Gln-Arg-Val-Asp (derived from N-terminus of canine kappa constant region). In another embodiment, the linker is GGNGT or YGNGT.

Aspect 40. An immunocytokine according to any preceding aspect wherein the IL-2 cytokine is human IL-2 (hIL-2) or a variant thereof.

IL-2 variants are as described in aspect 1.

There is also provided a variant cytokine, which may be any of the non-IL-2 cytokines described herein (including the non-IL-2 cytokines described in aspect 1, e.g. selected from IL-7, IL-15, IL-21, IL-12, GM-CSF, TNFα, CXCL9, CXCL10 and interferon-α). The definition of a variant IL-2 cytokine applies mutatis mutandis to the other cytokines (including immune stimulating cytokines and T-cell stimulating cytokines) described herein, e.g. comprising any of the N-terminal deletions described for IL-2 in aspect 1.

Aspect 41. An immunocytokine according to aspect 40, wherein the hIL-2 comprises or consists of the amino acid sequence of Seq ID No:301.

Aspect 42. An immunocytokine according to aspect 40, wherein the hIL-2 comprises a variant of IL-2 which comprises a modification at the N-terminus, optionally a deletion of from 1 to 10 amino acids.

As used in this aspect, a modification at the N-terminus of any of the cytokines described herein (including the non-IL-2 cytokines described in aspect 1, e.g. selected from IL-7, IL-15, IL-21, IL-12, GM-CSF, TNFα, CXCL9, CXCL10 and interferon-α) refers to one or more (such as 1 to 10, e.g. 1 to 5) amino acid substitutions, deletions or additions.

In one embodiment, the modification is one or more (such as 1 to 10, e.g. 1 to 5) amino acid substitutions at the N-terminus of the cytokine. Substitutions may be conservative substitutions, for example, as defined in concept 9, concept 29 or aspect 29. In one embodiment, the modification is a deletion. In another embodiment, the modification is an N-terminal deletion, for example, any of the deletions described in concept 9 and aspect 1. In one embodiment, the modification (such as a deletion of 1 to 10 amino acids) is within the final 50 amino acids of the N-terminus of the cytokine, e.g. the IL-2 cytokine. In one embodiment, the modification (such as a deletion of 1 to 10 amino acids) within the final 30 amino acids of the N-terminus of the cytokine, e.g. the IL-2 cytokine. In one embodiment, the modification (such as a deletion of 1 to 10 amino acids) within the final 25 amino acids of the N-terminus of the cytokine, e.g. the IL-2 cytokine. In one embodiment, the modification (such as a deletion of 1 to 10 amino acids) within the final 20 amino acids of the N-terminus of the cytokine, e.g. the IL-2 cytokine. In one embodiment, the modification (such as a deletion of 1 to 10 amino acids) within the final 15 amino acids of the N-terminus of the cytokine, e.g. the IL-2 cytokine. In one embodiment, the modification (such as a deletion of 1 to 10 amino acids) within the final 10 amino acids of the N-terminus of the cytokine, e.g. the IL-2 cytokine.

In one embodiment, the modification is a deletion of 1 to 9 amino acids from within the final 10 amino acids of the N-terminus of the cytokine, such as a deletion of the final 1 to 9 amino acids of the N-terminus of the cytokine. In one embodiment, the modification is a deletion of 1 to 8 amino acids from within the final 10 amino acids of the N-terminus of the cytokine, such as a deletion of the final 1 to 8 amino acids of the N-terminus of the cytokine. In one embodiment, the modification is a deletion of 1 to 7 amino acids from within the final 10 amino acids of the N-terminus of the cytokine, such as a deletion of the final 1 to 7 amino acids of the N-terminus of the cytokine. In one embodiment, the modification is a deletion of 1 to 6 amino acids from within the final 10 amino acids of the N-terminus of the cytokine, such as a deletion of the final 1 to 6 amino acids of the N-terminus of the cytokine. In one embodiment, the modification is a deletion of 1 to 5 amino acids from within the final 10 amino acids of the N-terminus of the cytokine, such as a deletion of the final 1 to 5 amino acids of the N-terminus of the cytokine. In one embodiment, the modification is a deletion of 1 to 4 amino acids from within the final 10 amino acids of the N-terminus of the cytokine, such as a deletion of the final 1 to 4 amino acids of the N-terminus of the cytokine. In one embodiment, the modification is a deletion of 1 to 3 amino acids from within the final 10 amino acids of the N-terminus of the cytokine, such as a deletion of the final 1 to 3 amino acids of the N-terminus of the cytokine. In one embodiment, the modification is a deletion of 1 or 2 amino acids from within the final 10 amino acids of the N-terminus of the cytokine, such as a deletion of the final 1 or 2 amino acids of the N-terminus of the cytokine. In one embodiment, the modification is a deletion of 1 amino acid from within the final 10 amino acids of the N-terminus of the cytokine, such as a deletion of the final amino acid of the N-terminus of the cytokine. In a particular embodiment, the cytokine is an IL-2 cytokine, such as a human IL-2 cytokine.

In one embodiment, the deletion is of the $9^{th}$ amino acid from the N-terminus of the cytokine, e.g. the IL-2 cytokine, for example the human IL-2 cytokine. In one embodiment, the deletion is of the $8^{th}$ and $9^{th}$ amino acid from the N-terminus of the cytokine, e.g. the IL-2 cytokine, for example the human IL-2 cytokine. In one embodiment, the deletion is of the $7^{th}$, $8^{th}$ and $9^{th}$ amino acid from the N-terminus of the cytokine, e.g. the IL-2 cytokine, for example the human IL-2 cytokine. In one embodiment, the deletion is of the $6^{th}$ to $9^{th}$ amino acid from the N-terminus of the cytokine, e.g. the IL-2 cytokine, for example the human IL-2 cytokine. In one embodiment, the deletion is of the $4^{th}$ to $9^{th}$ amino acid from the N-terminus of the cytokine, e.g. the IL-2 cytokine, for example the human IL-2 cytokine. In one embodiment, the deletion is of the $3^{rd}$ to $9^{th}$ amino acid from the N-terminus of the cytokine, e.g. the IL-2 cytokine, for example the human IL-2 cytokine. In one embodiment, the deletion is of the $2^{nd}$ to $9^{th}$ amino acid from the N-terminus of the cytokine, e.g. the IL-2 cytokine, for example the human IL-2 cytokine. In one embodiment, the deletion is of the $2^{nd}$ to $6^{th}$ amino acid from the N-terminus of the cytokine, e.g. the IL-2 cytokine, for example the human IL-2 cytokine. In one embodiment, the deletion is of the $3^{rd}$ to $7^{th}$ amino acid from the N-terminus of the cytokine, e.g. the IL-2 cytokine, for example the human IL-2 cytokine. In one embodiment, the deletion is of the 4th to 8th amino acid from the N-terminus of the cytokine, e.g. the IL-2 cytokine, for example the human IL-2 cytokine. Any of the deletions described in Aspect 1 hereinabove may be applied mutatis mutandis to the non-IL-2 cytokines of this aspect.

Aspect 42a. A variant hIL-2 comprising an N-terminal modification of any of the aspects or features of aspect 42. In one embodiment of aspect 42a, the variant hIL-2 is a purified variant hIL-2. In another embodiment of aspect 42a, the variant hIL-2 is an isolated and purified variant hIL-2.

Aspect 42b. A variant cytokine selected from IL-7, IL-15, IL-21, IL-12, GM-CSF, TNFα, CXCL9, CXCL10 and interferon-α comprising an N-terminal modification of any of the aspects or features of aspect 42. In one embodiment of aspect 42a, the variant cytokine is a purified variant cytokine. In another embodiment of aspect 42a, the variant cytokine is an isolated and purified variant cytokine.

Aspect 43. An immunocytokine according to aspect 40 or aspect 42, wherein the hIL-2 comprises a variant IL-2 comprising an N-terminal sequence selected from Seq ID No:303 to 323.

Aspect 43a. A variant hIL-2 comprising an N-terminal sequence selected from Seq ID No:303 to 323.

In one embodiment of aspect 43a, the variant hIL-2 is a purified variant hIL-2. In another embodiment of aspect 43a, the variant hIL-2 is an isolated and purified variant hIL-2. In one embodiment, the variant hIL-2 comprises (or consists) of an N-term terminal sequence selected from Seq ID No:303 to 323 directly fused to an IL-2 sequence selected from Seq ID No:324, 517 and 518.

Aspect 44. An immunocytokine according to any one of aspects 40, 42 or 43 wherein the hIL-2 variant comprises one or more (such as 1 to 5, e.g. one or two) mutations independently selected from the following:
1) D20 (such as D20T);
2) R38 (such as R38W, R38A or R38Q);
3) F42 (such as F42A or F42K);
4) Y45 (such as Y45A);
5) E62 (such as E62A);
6) N88 (such as N88R);
7) C125 (such as C125S);
8) Q126 (such as Q126W); or
9) R38 and F42 (such as R38W and F42K or R38A and F42A);
wherein the residue numbering is defined with reference to the human wild-type IL-2 sequence, Seq ID No:301.

Aspect 44a. A variant hIL-2 according to any one of aspects 42a or 43a wherein the hIL-2 variant comprises one or more (such as 1 to 5, e.g. one or two) mutations independently selected from the following:
1) D20 (such as D20T);
2) R38 (such as R38W, R38A or R38Q);
3) F42 (such as F42A or F42K);
4) Y45 (such as Y45A);
5) E62 (such as E62A);
6) N88 (such as N88R);
7) C125 (such as C125S);
8) Q126 (such as Q126W); or
9) R38 and F42 (such as R38W and F42K or R38A and F42A);
wherein the residue numbering is defined with reference to the human wild-type IL-2 sequence, Seq ID No:301.

In one embodiment, the variant hIL-2 comprises (or consists) of an R38 (such as R38W, R38A or R38Q, e.g. R38A) mutation. In one embodiment, the variant hIL-2 comprises (or consists) of an F42 (such as F42A or F42K, e.g. F42A) mutation. In one embodiment, the variant hIL-2 comprises (or consists) of a Y45 (such as Y45A) mutation. In one embodiment, the variant hIL-2 comprises (or consists) of an E62 (such as E62A) mutation.

In one embodiment, the variant hIL-2 comprises (or consists) of an R38 (such as R38W, R38A or R38Q, e.g. R38A) mutation and an F42 (such as F42A or F42K, e.g. F42A) mutation. In one embodiment, the variant hIL-2 comprises (or consists) of an R38 (such as R38W, R38A or R38Q, e.g. R38A) and a Y45 (such as Y45A) mutation. In one embodiment, the variant hIL-2 comprises (or consists) of an R38 (such as R38W, R38A or R38Q, e.g. R38A) mutation and an E62 (such as E62A). In one embodiment, the variant hIL-2 comprises (or consists) of a Y45 (such as Y45A) mutation and an E62 (such as E62A). In one embodiment, the variant hIL-2 comprises (or consists) of an F42 (such as F42A or F42K, e.g. F42A) mutation and an E62 (such as E62A) mutation. In one embodiment, the variant hIL-2 comprises (or consists) of an F42 (such as F42A or F42K, e.g. F42A) mutation and a Y45 (such as Y45A) mutation.

In one embodiment, the variant hIL-2 comprises (or consists) of an R38 (such as R38W, R38A or R38Q, e.g. R38A) mutation, an F42 (such as F42A or F42K, e.g. F42A) mutation and a Y45 (such as Y45A) mutation. In one embodiment, the variant hIL-2 comprises (or consists) of an R38 (such as R38W, R38A or R38Q, e.g. R38A) mutation, an F42 (such as F42A or F42K, e.g. F42A) mutation and an E62 (such as E62A) mutation. In one embodiment, the variant hIL-2 comprises (or consists) of an R38 (such as R38W, R38A or R38Q, e.g. R38A) mutation, a Y45 (such as Y45A) mutation and an E62 (such as E62A) mutation.

In one embodiment, the variant hIL-2 comprises (or consists) of an R38 (such as R38W, R38A or R38Q, e.g. R38A) mutation, an F42 (such as F42A or F42K, e.g. F42A) mutation, a Y45 (such as Y45A) mutation and an E62 (such as E62A) mutation. In one embodiment, the variant hIL-2 comprises (or consists) of an R38A, F42A, Y45A and an E62A mutation.

Other hIL-2 mutations are known to those skilled in the art. In one embodiment, the hIL-2 mutations are those described in WO2012/062228 (see claims 2 to 7, incorporated herein by reference). In one embodiment, the hIL-2 mutations are those described in WO1999/60128 (see claims 6, 7, 8, 10, 11 and 12 incorporated herein by reference). In one embodiment, the hIL-2 mutations are those described in WO1993/20849 (see claims 4 and 5 incorporated herein by reference). In one embodiment, the hIL-2 mutations are those described in WO2003/015697 (see claims 7 and 10 incorporated herein by reference). In one embodiment, the hIL-2 mutations are those described in WO2005/007121 (see claims 9 to 14 incorporated herein by reference). In one embodiment, the hIL-2 mutations are those described in WO2005/086798 (see claims 5 to 10 incorporated herein by reference). In one embodiment, the hIL-2 mutations are those described in WO2005/086751 (see claims 5 to 9 incorporated herein by reference). In one embodiment, the hIL-2 mutations are those described in WO2009/061853 (see claim 5 incorporated herein by reference). In one embodiment, the hIL-2 mutations are those described in WO2012/088446 (see claims 3 to 8 and 11 to 13 incorporated herein by reference). In one embodiment, the hIL-2 mutations are those described in WO2012/107417 (see claims 2, 4, 6 and 9, incorporated herein by reference). In one embodiment, the hIL-2 mutations are those described in WO2012/119093 (see claims 1 to 7, incorporated herein by reference). In one embodiment, the hIL-2 mutations are those described in WO2015/164815 (see claims 3 to 19, incorporated herein by reference).

In these aspects, where the residue numbering is defined with reference to the human wild-type IL-2 sequence, if, for example, there is a single amino acid deletion from the N-terminus of the cytokine, and the claim described an N88 amino acid mutation, then, for the variant IL-2 having the single amino acid deletion, the N will in fact be at position 87. If the cytokine has 3 amino acids deleted from the N-terminus, and the mutation is an F42A mutation, then the position to be mutated, will in fact be F39 in the variant sequence.

Aspect 45. An immunocytokine according to aspect 40, wherein the hIL-2 comprises a variant IL-2 consists of an N-terminal sequence selected from Seq ID No:242 to 262 fused to the amino acid sequence of Seq ID No:324.

In one embodiment, the variant hIL-2 comprises (or consists) of an N-terminal sequence selected from Seq ID No:303 to 323 fused to the amino acid sequence selected from Seq ID No:324, 517 and 518.

In one embodiment, the immunocytokine is 1D05 D1-9 ICK. In one embodiment, the immunocytokine is 1D05 D1-9. In one embodiment, the immunocytokine is 1D05 D9-2 ICK. In one embodiment, the immunocytokine is 1D05 D9-7 ICK.

Aspect 45a. A variant hIL-2 comprising an N-terminal sequence selected from Seq ID No:303 to 323 fused to the amino acids sequence of Seq ID No:324.

In one embodiment of aspect 45a, the variant hIL-2 is a purified variant hIL-2. In another embodiment of aspect 44a, the variant hIL-2 is an isolated and purified variant hIL-2.

Aspect 46. An immunocytokine according to any preceding aspect, wherein the IL-2 cytokine binds to the high affinity (αβγ) IL-2 receptor with a potency less than free IL-2, for example with an $EC_{50}$ of greater than 20 pM, greater than 50 pM or greater than 100 pM, e.g. when measured in a cell-based proliferative assay.

Free IL-2 has a potency of approximately 10 pM against the αβγ (high affinity) receptor in a cell-based proliferative assay. As used herein, $EC_{50}$ refers to the effective concentration to give 50% of maximal activation of the IL2R. The higher the $EC_{50}$, the less potent the substance is, thus a substance having an $EC_{50}$ of 1 pM is more potent than a substance with an $EC_{50}$ of 1 nM. The sequences of the α-chain, β-chain and γ-chain are provided in Seq ID Nos: 327, 328 and 329 respectively.

In one embodiment, the IL-2 cytokine has an $EC_{50}$ in the range of 5 pM to 20 pM. In one embodiment, the $EC_{50}$ is in the range of 5 pM to 1 nM. In one embodiment, the $EC_{50}$ is in the range of 5 pM to 750 pM, 5 pM to 500 pM, 5 pM to 250 pM or 5 pm to 100 pM, e.g. 5 pM to 50 pM.

In one embodiment, the $EC_{50}$ is in the range of 10 pM to 1 nM. In one embodiment, the $EC_{50}$ is in the range of 10 pM to 750 pM, 10 pM to 500 pM, 10 pM to 250 pM or 10 pm to 100 pM, e.g. 10 pM to 50 pM, or 10 pM to 30 pM.

In one embodiment, the $EC_{50}$ is in the range of 20 pM to 1 nM. In one embodiment, the $EC_{50}$ is in the range of 20 pM to 750 pM, 20 pM to 500 pM, 20 pM to 250 pM or 20 pm to 100 pM, e.g. 20 pM to 50 pM.

In another embodiment, the IL-2 cytokine has an $EC_{50}$ in the range of 50 pM to 1 nM. In one embodiment, the $EC_{50}$ is in the range of 50 pM to 750 pM, 50 pM to 500 pM, 50 pM to 250 pM or 50 pm to 100 pM, e.g. 50 pM to 75 pM. In another embodiment, the IL-2 cytokine has an $EC_{50}$ in the range of 100 pM to 1 nM. In one embodiment, the $EC_{50}$ is in the range of 100 pM to 800 pM, 100 pM to 700 pM, 100 pM to 600 pM or 100 pm to 500 pM, e.g. 100 pM to 400 pM.

In another embodiment, the IL-2 cytokine has an $EC_{50}$ in the range of 100 pm to 300 pM. In another embodiment, the IL-2 cytokine has an $EC_{50}$ in the range of 100 pm to 200 pM.

In another embodiment, the $EC_{50}$ is greater than 5 pM. In another embodiment, the $EC_{50}$ is greater than 10 pM. In another embodiment, the $EC_{50}$ is greater than 20 pM. In another embodiment, the $EC_{50}$ is greater than 30 pM, greater than 40 pM, greater than 50 pM, greater than 60 pM or greater than 70 pM. In another embodiment, the $EC_{50}$ is greater than 100 pM, greater than 125 pM, greater than 150 pM, greater than 175 pM or greater than 200 pM. In another embodiment, the $EC_{50}$ is greater than 250 pM, greater than 300 pM, greater than 350 pM, greater than 400 pM. In another embodiment, the $EC_{50}$ is greater than 500 pM, greater than 600 pM, greater than 700 pM or greater than 800 pM.

In one embodiment, the $EC_{50}$ is less than 5 nM. In one embodiment, the $EC_{50}$ is less than 1 nM. In one embodiment, the $EC_{50}$ is less than 800 pM. In one embodiment, the $EC_{50}$ is less than 700 pM. In one embodiment, the $EC_{50}$ is less than 600 pM. In one embodiment, the $EC_{50}$ is less than 500 pM. In one embodiment, the $EC_{50}$ is less than 400 pM. In one embodiment, the $EC_{50}$ is less than 300 pM. In one embodiment, the $EC_{50}$ is less than 200 pM. In one embodiment, the $EC_{50}$ is less than 100 pM. In one embodiment, the $EC_{50}$ is less than 50 pM.

The potency of the immunocytokine against the αβγ IL-2R may be measured in a cell-based proliferative assay, which are well-known to those skilled in the art and are detailed more in the Examples hereinbelow (see Example 13 and FIG. 12).

Aspect 47. An immunocytokine according to any preceding aspect, wherein the IL-2 binds to the intermediate affinity (βγ) IL-2 receptor with a potency less than free IL-2, for example with an $EC_{50}$ of greater than 1 nM, greater than 5 nM or greater than 10 nM, e.g. when measured in a cell-based proliferative assay.

Free IL-2 has a potency of approximately 100 pM against the βγ (intermediate affinity) receptor in a cell-based proliferative assay. As used herein, $EC_{50}$ refers to the effective concentration to give 50% of maximal activation of the IL-2R. The higher the $EC_{50}$, the less potent the substance is, thus a substance having an $EC_{50}$ of 1 pM is more potent than a substance with an $EC_{50}$ of 1 nM. The sequences of the α-chain, β-chain and γ-chain are provided in Seq ID Nos: 327, 328 and 329 respectively.

In one embodiment, the $EC_{50}$ is in the range of 1 to 100 nM. In one embodiment, the $EC_{50}$ is in the range of 10 nM to 100 nM. In one embodiment, the $EC_{50}$ is in the range of 20 nM to 100 nM. In another embodiment, the IL-2 cytokine has an $EC_{50}$ in the range of 30 nM to 100 nM, 40 nM to 100 nM, 50 nM to 100 nM. In one embodiment, the $EC_{50}$ is in the range of 50 nM to 100 nM, 60 nM to 100 nM, 70 nM to 100 nM.

In one embodiment, the $EC_{50}$ is in the range of 1 to 50 nM. In one embodiment, the $EC_{50}$ is in the range of 10 nM to 50 nM. In one embodiment, the $EC_{50}$ is in the range of 20 nM to 50 nM. In another embodiment, the IL-2 cytokine has an $EC_{50}$ in the range of 30 nM to 50 nM or 40 nM to 50 nM.

In one embodiment, the $EC_{50}$ is in the range of 1 to 10 nM. In one embodiment, the $EC_{50}$ is in the range of 1 to 20 nM. In one embodiment, the $EC_{50}$ is in the range of 1 to 30 nM. In one embodiment, the $EC_{50}$ is in the range of 1 nM to 9 nM. In one embodiment, the $EC_{50}$ is in the range of 1 nM to 8 nM.

In another embodiment, the IL-2 cytokine has an $EC_{50}$ in the range of 1 nM to 7 nM, 1 nM to 6 nM or 1 nM to 5 nM.

In another embodiment, the $EC_{50}$ is greater than 0.5 nM, greater than 0.6 nM, greater than 0.7 nM, greater than 0.8 nM or greater than 0.9 nM. In another embodiment, the $EC_{50}$ is greater than 1 nM, greater than 1.25 nM, greater than 1.5 nM, greater than 1.75 nM or greater than 2 nM. In another embodiment, the $EC_{50}$ is greater than 2.5 nM, greater than 3 nM, greater than 3.5 nM, greater than 4 nM. In another embodiment, the $EC_{50}$ is greater than 5 nM, greater than 6 nM, greater than 7 nM or greater than 8 nM. In a particular embodiment, the $EC_{50}$ is greater than 1 nM.

In one embodiment, the $EC_{50}$ is less than 10 nM. In one embodiment, the $EC_{50}$ is less than 20 nM. In one embodiment, the $EC_{50}$ is less than 30 nM. In one embodiment, the $EC_{50}$ is less than 40 nM. In one embodiment, the $EC_{50}$ is less than 50 nM.

In one embodiment, the $EC_{50}$ is less than 100 nM. In one embodiment, the $EC_{50}$ is less than 200 nM. In one embodiment, the $EC_{50}$ is less than 300 nM.

In another embodiment, the $EC_{50}$ is less than 75 nM or less than 50 nM.

In one embodiment, the IL-2 shows no detectable potency against the $\beta\gamma$ IL-2R in a cell-based proliferative assay.

The potency of the immunocytokine against the $\beta\gamma$ IL-2R may be measured in a cell-based proliferative assay, which are well-known to those skilled in the art and are detailed more in the Examples hereinbelow (see Example 13 and FIG. 12).

Aspect 48. An immunocytokine according to any preceding aspect, wherein the IL-2 preferentially binds to the high affinity ($\alpha\beta\gamma$) IL-2 receptor over the intermediate affinity ($\beta\gamma$) IL-2 receptor.

Aspect 49. An immunocytokine according to aspect 48, wherein the ratio of IL-2 potency against the high affinity ($\alpha\beta\gamma$) IL-2 receptor:intermediate affinity ($\beta\gamma$) IL-2 receptor is at least 2:1.

In one embodiment, the ratio is at least 3:1. In one embodiment, the ratio is at least 4:1. In one embodiment, the ratio is at least 5:1. In one embodiment, the ratio is at least 7.5:1. In one embodiment, the ratio is at least 10:1. In one embodiment, the ratio is at least 12.5:1. In one embodiment, the ratio is at least 15:1. In one embodiment, the ratio is at least 17.5:1. In one embodiment, the ratio is at least 20:1.

In another embodiment, the ratio is at least 50:1. In another embodiment, the ratio is at least 75:1. In another embodiment, the ratio is at least 100:1. In another embodiment, the ratio is at least 250:1. In another embodiment, the ratio is at least 500:1. In another embodiment, the ratio is at least 750:1. In another embodiment, the ratio is at least 1000:1.

In another embodiment, the ratio is at least 1250:1. In another embodiment, the ratio is at least 1500:1. In another embodiment, the ratio is at least 1750:1. In another embodiment, the ratio is at least 2000:1.

Aspect 50. An immunocytokine according to any preceding aspect, wherein the antigen binding site binds to hPD-L1 with an affinity of less than 500 pM (e.g. less than 300 pM or less than 200 pM), optionally wherein the immunocytokine provides a ratio of the potency of the IL-2 cytokine against the high affinity ($\alpha\beta\gamma$) receptor: affinity of the anti-PD-L1 antigen binding site against hPD-L1 of at least 2:1.

In one embodiment, the antigen binding site binds to hPD-L1 with an affinity of less than 200 pM. In one embodiment, the antigen binding site binds to hPD-L1 with an affinity of less than 100 pM, or less than 50 pM.

In one embodiment, the antigen binding site binds to hPD-L1 with an affinity of between 50 pM and 500 pM, or between 75 pM and 500 pM, or between 100 pM and 500 pM or between 200 pM and 500 pM.

In one embodiment, the antigen binding site binds to hPD-L1 with an affinity of between 50 pM and 400 pM, or between 50 pM and 300 pM, or between 50 pM and 200 pM or between 50 pM and 100 pM.

In one embodiment, the antigen binding site binds to hPD-L1 with an affinity of between 100 pM and 500 pM, or between 100 pM and 400 pM, or between 100 pM and 300 pM.

In one embodiment, the ratio of the potency of the IL-2 cytokine against the high affinity ($\alpha\beta\gamma$) receptor: affinity of the anti-PD-L1 antigen binding site against hPD-L1 is at least 3:1. In one embodiment, the ratio of the potency of the IL-2 cytokine against the high affinity ($\alpha\beta\gamma$) receptor: affinity of the anti-PD-L1 antigen binding site against hPD-L1 is at least 4:1. In one embodiment, the ratio of the potency of the IL-2 cytokine against the high affinity ($\alpha\beta\gamma$) receptor: affinity of the anti-PD-L1 antigen binding site against hPD-L1 is at least 5:1. In one embodiment, the ratio of the potency of the IL-2 cytokine against the high affinity ($\alpha\beta\gamma$) receptor: affinity of the anti-PD-L1 antigen binding site against hPD-L1 is at least 7:1. In one embodiment, the ratio of the potency of the IL-2 cytokine against the high affinity ($\alpha\beta\gamma$) receptor: affinity of the anti-PD-L1 antigen binding site against hPD-L1 is at least 10:1.

Any of the half-life, $K_{ON}$ rates, $K_{OFF}$ rates, or binding characteristics of the anti-PD-L1 antibodies in concepts 1 to 40 applu mutatis mutandis to the immunocytokines disclosed herein.

Aspect 50a. An immunocytokine according to any preceding aspect, wherein the antigen binding site binds to mPD-L1 (Seq ID No:325) with an affinity of less than 500 nM (e.g. less than 100 nM, less than 10 nM or less than 1 nm).

In one embodiment, the antigen binding site binds to hPD-L1 with an affinity of between 1 nM and 500 nM, or between 1 nM and 250 nM, or between 1 nM and 100 nM, or between 1 nM and 50 nM.

In one embodiment, the antigen binding site binds to hPD-L1 with an affinity of between 10 nM and 500 nM, or between 10 nM and 250 nM, or between 10 nM and 100 nM, or between 1 nM and 50 nM, in particular between 10 nM and 100 nM.

In one embodiment, the antigen binding site binds to hPD-L1 with an affinity of between 100 nM and 500 nM, or between 100 nM and 400 nM, or between 100 nM and 300 nM, or between 100 nM and 200 nM.

The affinity of the antigen-binding site to hPD-L1 or mPD-L1 may be measured by any technique well-known to those skilled in the art. In one embodiment, the affinity is measured using SPR, the details of which are provided hereinabove.

Aspect 51. An immunocytokine as defined in any preceding aspect for use in treating or preventing a hPD-L1-mediated disease or condition, e.g. selected from neoplastic or non-neoplastic disease, chronic viral infections, and malignant tumours, such as melanoma, breast cancer, ovarian cancer, Merkel cell carcinoma, non-small cell lung cancer (squamous and non-squamous), renal cell cancer, bladder cancer, colorectal cancer (without MSI or microsatellite instability), head and neck squamous cell carcinoma, mesothelioma, virally induced cancers (such as cervical cancer and nasopharyngeal cancer), soft tissue sarcomas, haematological malignancies such as Hodgkin's and non-Hodgkin's disease, diffuse large B-cell lymphoma (for example melanoma, breast cancer, ovarian cancer, Merkel cell carcinoma, non-small cell lung cancer (squamous and non-squamous), renal cell cancer, bladder cancer, colorectal cancer (without MSI or microsatellite instability), head and neck squamous cell carcinoma and mesothelioma or for example virally induced cancers (such as cervical cancer and nasopharyngeal cancer) and soft tissue sarcomas).

Aspect 52. Use of an immunocytokine as defined in any one of aspects 1 to 50 in the manufacture of a medicament for administration to a human for treating or preventing a hPD-L1 mediated disease or condition in the human, e.g. wherein the hPD-L1 mediated disease or condition is selected from neoplastic or non-neoplastic disease, chronic viral infections, and malignant tumours, such as melanoma, breast cancer, ovarian cancer, Merkel cell carcinoma, non-small cell lung cancer (squamous and non-squamous), renal cell cancer, bladder cancer, colorectal cancer (without MSI or microsatellite instability), head and neck squamous cell carcinoma, mesothelioma, virally induced cancers (such as cervical cancer and nasopharyngeal cancer), soft tissue sarcomas, haematological malignancies such as Hodgkin's and non-Hodgkin's disease, diffuse large B-cell lymphoma (for example melanoma, breast cancer, ovarian cancer, Merkel cell carcinoma, non-small cell lung cancer (squamous and non-squamous), renal cell cancer, bladder cancer, colorectal cancer (without MSI or microsatellite instability), head and neck squamous cell carcinoma and mesothelioma or for example virally induced cancers (such as cervical cancer and nasopharyngeal cancer) and soft tissue sarcomas).

Aspect 53. A method of treating or preventing a hPD-L1 mediated disease or condition, e.g. selected from neoplastic or non-neoplastic disease, chronic viral infections, and malignant tumours, such as melanoma, breast cancer, ovarian cancer, Merkel cell carcinoma, non-small cell lung cancer (squamous and non-squamous), renal cell cancer, bladder cancer, colorectal cancer (without MSI or microsatellite instability), head and neck squamous cell carcinoma, mesothelioma, virally induced cancers (such as cervical cancer and nasopharyngeal cancer), soft tissue sarcomas, haematological malignancies such as Hodgkin's and non-Hodgkin's disease, diffuse large B-cell lymphoma (for example melanoma, breast cancer, ovarian cancer, Merkel cell carcinoma, non-small cell lung cancer (squamous and non-squamous), renal cell cancer, bladder cancer, colorectal cancer (without MSI or microsatellite instability), head and neck squamous cell carcinoma and mesothelioma or for example virally induced cancers (such as cervical cancer and nasopharyngeal cancer) and soft tissue sarcomas) in a human, comprising administering to said human a therapeutically effective amount of an immunocytokine as defined in any one of aspects 1 to 50, wherein the hPD-L1 mediated disease or condition is thereby treated or prevented.

In any of aspects 51 to 53, the hPD-L1 mediated disease may be any of those as described herein. In one embodiment, in any of aspects 51 to 53, the hPD-L1 mediated disease is a virally induced cancer, such as cervical cancer and nasopharyngeal cancer, for example cervical cancers caused by HPV infection. In one embodiment, in any of aspects 51 to 53, the hPD-L1 mediated disease is a chronic viral infection. In one embodiment, in any of aspects 51 to 53, the hPD-L1 mediated disease is a neoplastic disease. In one embodiment, in any of aspects 51 to 53, the hPD-L1 mediated disease is a non-neoplastic disease. In one embodiment, in any of aspects 51 to 53, the hPD-L1 mediated disease is a malignant tumour. In one embodiment, in any of aspects 51 to 53, the hPD-L1 mediated disease is a cancer which is known to be responsive to PD-L1 therapy, such as melanoma, Merkel cell carcinoma, non-small cell lung cancer (squamous and non-squamous), renal cell cancer, bladder cancer, head and neck squamous cell carcinoma, mesothelioma. In one embodiment, in any of aspects 51 to 53, the hPD-L1 mediated disease is a cancer which is a soft tissue sarcoma.

In one embodiment, in any of aspects 51 to 53, the hPD-L1 mediated disease is a neurodegenerative disease, disorder or condition, optionally wherein the neurodegenerative disease, disorder or condition is selected from Alzheimer's disease, amyotrophic lateral sclerosis, Parkinson's disease, Huntington's disease, primary progressive multiple sclerosis, secondary progressive multiple sclerosis, corticobasal degeneration, Rett syndrome, a retinal degeneration disorder selected from age-related macular degeneration and retinitis pigmentosa; anterior ischemic optic neuropathy, glaucoma, uveitis, depression, trauma-associated stress or post-traumatic stress disorder, frontotemporal dementia, Lewy body dementias, mild cognitive impairments, posterior cortical atrophy, primary progressive aphasia and progressive supranuclear palsy or aged-related dementia, in particular Alzheimer's disease, amyotrophic lateral sclerosis, Parkinson's disease and Huntington's disease, and e.g. Alzheimer's disease.

Aspect 54. The immunocytokine according to aspect 51, the use according to aspect 52 or the method according to aspect 53, wherein the hPD-L1-mediated disease or condition is cancer.

Aspect 55. The immunocytokine, the use or the method according to aspect 54, wherein the cancer is selected from melanoma, Merkel cell cancer, non-small cell lung cancer, bladder cancer, Non-Hodgkin's lymphomas, colorectal cancer with microsatellite instability (MSI) or a cancer selected from breast cancer, ovarian cancer, colorectal cancer (without MSI or microsatellite instability), in particular melanoma and renal cell cancer.

In one embodiment, the cancer is a cancer which is known to be responsive to both IL-2 therapy and PD-L1 therapy, such as melanoma and renal cell cancer.

In one embodiment, the cancer is colorectal cancer with microsatellite instability (MSI). In one embodiment, the cancer is breast cancer. In one embodiment, the cancer is ovarian cancer.

Aspect 56. The immunocytokine, use or the method according to any one of aspects 51 to 55, further comprising administering to the human a further therapy, for example a further therapeutic agent, optionally wherein the further therapeutic agent is independently selected from the group consisting of:
  A) other immune checkpoint inhibitors (such as anti-TIM-3 antibodies, anti-CTLA-4 antibodies, anti-TIGIT antibodies and anti-LAG-3 antibodies);
  B) immune stimulators (such as anti-OX40 antibodies, anti-GITR antibodies, anti-CD137 antibodies, anti-ICOS antibodies and anti-CD40 antibodies);
  C) chemokine receptor antagonists (such as CXCR4, CCR4 and CXCR2);
  D) targeted kinase inhibitors (such as CSF-1R or VEGFR inhibitors);
  E) angiogenesis inhibitors (such as anti-VEGF-A or Delta-like Ligand-4);
  F) immune stimulating peptides or chemokines (such as CXCL9 or CXCL10);
  G) cytokines (such as IL-15 and IL-21);
  H) bispecific T-cell engagers (BiTEs) having at least one specificity against CD3 (e.g. CD3/CD19 BiTE);
  I) other bi-specific molecules (for example IL-15-containing molecules targeted towards tumour associated antigens, for example Epidermal growth factor receptors such as EGFR, Her-2, New York Esophageal Cancer-1 (NY-ESO-1), GD2, EpCAM or Melanoma Associated Antigen-3 (MAGE-A3));
J) oncolytic viruses (such as HSV virus (optionally which secretes GMCSF), Newcastle disease virus and Vaccinia virus);
K) vaccination with tumour associated antigens (such as New York Esophageal Cancer-1 [NY-ESO-1], Melanoma Associated Antigen-3 [MAGE-3]);
L) cell-based therapies (such as chimeric Antigen Receptor-T-cells (CAR-T) for example expressing anti-CD19, anti-EpCam or anti-mesothelin);
M) bi-specific NK cell engagers having a specificity against an activating MK receptor such as NKG2D or CD16a; and
N) adoptive transfer of tumour specific T-cells or LAK cells, or optionally wherein the further therapy is chemotherapy, radiotherapy and surgical removal of tumours.

Radiotherapy may be single dose or in fractionated doses, either delivered to affected tissues directly or to the whole body.

In this aspect, any of the features and embodiments of concept 46 apply mutatis mutandis.

In this aspect, the bispecific molecules include "bispecific antibodies" and antibody fusion proteins, including those formats and molecules described in concepts 37 to 40.

The antibodies may be any of the sequences or antibodies described in arrangement 5, 5a or detailed in Aspect 1a.

Aspect 57. A pharmaceutical composition comprising an immunocytokine as defined in any one of aspects 1 to 50 and a pharmaceutically acceptable excipient, diluent or carrier and optionally further comprising a further therapeutic agent independently selected from the group consisting of:
A) other immune checkpoint inhibitors (such as anti-TIM-3 antibodies, anti-CTLA-4 antibodies, anti-TIGIT antibodies and anti-LAG-3 antibodies);
B) immune stimulators (such as anti-OX40 antibodies, anti-GITR antibodies, anti-CD137 antibodies, anti-ICOS antibodies and anti-CD40 antibodies);
C) chemokine receptor antagonists (such as CXCR4, CCR4 and CXCR2);
D) targeted kinase inhibitors (such as CSF-1R or VEGFR inhibitors);
E) angiogenesis inhibitors (such as anti-VEGF-A or Delta-like Ligand-4);
F) immune stimulating peptides or chemokines (such as CXCL9 or CXCL10);
G) cytokines (such as IL-15 and IL-21);
H) bispecific T-cell engagers (BiTEs) having at least one specificity against CD3 (e.g. CD3/CD19 BiTE);
I) other bi-specific molecules (for example IL-15-containing molecules targeted towards tumour associated antigens, for example Epidermal growth factor receptors such as EGFR, Her-2, New York Esophageal Cancer-1 (NY-ESO-1), GD2, EpCAM or Melanoma Associated Antigen-3 (MAGE-A3));
J) oncolytic viruses (such as HSV virus (optionally which secretes GMCSF), Newcastle disease virus and Vaccinia virus);
K) vaccination with tumour associated antigens (such as New York Esophageal Cancer-1 [NY-ESO-1], Melanoma Associated Antigen-3 [MAGE-3]);
L) cell-based therapies (such as chimeric Antigen Receptor-T-cells (CAR-T) for example expressing anti-CD19, anti-EpCam or anti-mesothelin);
M) bi-specific NK cell engagers having a specificity against an activating MK receptor such as NKG2D or CD16a; and
N) adoptive transfer of tumour specific T-cells or LAK cells.

In one embodiment, the further therapeutic agent is administered sequentially or simultaneously with the immunocytokine.

In this aspect, any of the features and embodiments of concept 48 apply mutatis mutandis.

In this aspect, the bispecific molecules include "bispecific antibodies" and antibody fusion proteins, including those formats and molecules described in concepts 37 to 40.

The antibodies may be any of the sequences or antibodies described in arrangement 5, 5a or detailed in Aspect 1a.

Aspect 58. A pharmaceutical composition according to aspect 57, or a kit comprising a pharmaceutical composition as defined in aspect 57, wherein the composition is for treating and/or preventing a hPD-L1 mediated disease or condition, e.g. selected from neoplastic or non-neoplastic disease, chronic viral infections, and malignant tumours, such as melanoma, breast cancer, ovarian cancer, Merkel cell carcinoma, non-small cell lung cancer (squamous and non-squamous), renal cell cancer, bladder cancer, colorectal cancer (without MSI or microsatellite instability), head and neck squamous cell carcinoma, mesothelioma, virally induced cancers (such as cervical cancer and nasopharyngeal cancer), soft tissue sarcomas, haematological malignancies such as Hodgkin's and non-Hodgkin's disease, diffuse large B-cell lymphoma (for example melanoma, breast cancer, ovarian cancer, Merkel cell carcinoma, non-small cell lung cancer (squamous and non-squamous), renal cell cancer, bladder cancer, colorectal cancer (without MSI or microsatellite instability), head and neck squamous cell carcinoma and mesothelioma or for example virally induced cancers (such as cervical cancer and nasopharyngeal cancer) and soft tissue sarcomas).

Aspect 59. A pharmaceutical composition according to aspect 57 or aspect 58 in combination with, or kit according to aspect 58 comprising a label or instructions for use to treat and/or prevent said disease or condition in a human; optionally wherein the label or instructions comprise a marketing authorisation number (e.g., an FDA or EMA authorisation number); optionally wherein the kit comprises an IV or injection device that comprises the immunocytokine.

Aspect 60. A method of treating a proliferative disease in an animal (e.g. a human), comprising administering an effective amount of an immunocytokine as defined in any one of aspects 1 to 50 to said patient.

Proliferative diseases may be any as described elsewhere herein.

Aspect 61. A nucleic acid that encodes a heavy chain and/or a light chain of an immunocytokine as defined in any one of aspects 1 to 50.

In one embodiment, the nucleic acid encodes a light chain of an immunocytokine as defined in any one of aspects 1 to 50.

Aspect 62. A vector comprising the nucleic acid as defined in aspect 61; optionally wherein the vector is a CHO or HEK293 vector.

Aspect 63. A host comprising the nucleic acid as defined in aspect 61 or the vector as defined in aspect 62.

4. ICOS Antibodies

ICOS antibodies are provided herein. The ICOS antibodies may be any of those described in GB patent application 1620414.1 (filed 1 Dec. 2016), the sequences of the anti-ICOS antibodies disclosed therein are incorporated herein by reference.

STIM001 has a heavy chain variable region ($V_H$) amino acid sequence of Seq ID No:366, comprising the CDRH1 amino acid sequence of Seq ID No:363, the CDRH2 amino acid sequence of Seq ID No:364, and the CDRH3 amino acid sequence of Seq ID No:365. The heavy chain nucleic acid sequence of the $V_H$ domain is Seq ID No:367. STIM001 has a light chain variable region ($V_L$) amino acid sequence of Seq ID No:373, comprising the CDRL1 amino acid sequence of Seq ID No:370, the CDRL2 amino acid sequence of Seq ID No:371, and the CDRL3 amino acid sequence of Seq ID No:372. The light chain nucleic acid sequence of the $V_L$ domain is Seq ID No:374. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:368 (heavy chain nucleic acid sequence Seq ID No:369). A full length light chain amino acid sequence is Seq ID No:375 (light chain nucleic acid sequence Seq ID No:376).

STIM002 has a heavy chain variable region ($V_H$) amino acid sequence of Seq ID No:380, comprising the CDRH1 amino acid sequence of Seq ID No:377, the CDRH2 amino acid sequence of Seq ID No:378, and the CDRH3 amino acid sequence of Seq ID No:379. The heavy chain nucleic acid sequence of the $V_H$ domain is Seq ID No:381. STIM002 has a light chain variable region ($V_L$) amino acid sequence of Seq ID No:387, comprising the CDRL1 amino acid sequence of Seq ID No:384, the CDRL2 amino acid sequence of Seq ID No:385, and the CDRL3 amino acid sequence of Seq ID No:386. The light chain nucleic acid sequence of the $V_L$ domain is Seq ID No:388 or Seq ID No:519. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:382 (heavy chain nucleic acid sequence Seq ID No:383). A full length light chain amino acid sequence is Seq ID No:389 (light chain nucleic acid sequence Seq ID No:390 or or Seq ID No:520).

STIM002-B has a heavy chain variable region ($V_H$) amino acid sequence of Seq ID No:394, comprising the CDRH1 amino acid sequence of Seq ID No:391, the CDRH2 amino acid sequence of Seq ID No:392, and the CDRH3 amino acid sequence of Seq ID No:393. The heavy chain nucleic acid sequence of the $V_H$ domain is Seq ID No:395. STIM002-B has a light chain variable region ($V_L$) amino acid sequence of Seq ID No:401, comprising the CDRL1 amino acid sequence of Seq ID No:398, the CDRL2 amino acid sequence of Seq ID No:399, and the CDRL3 amino acid sequence of Seq ID No:400. The light chain nucleic acid sequence of the $V_L$ domain is Seq ID No:402. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:396 (heavy chain nucleic acid sequence Seq ID No:397). A full length light chain amino acid sequence is Seq ID No:403 (light chain nucleic acid sequence Seq ID No:404).

STIM003 has a heavy chain variable region ($V_H$) amino acid sequence of Seq ID No:408, comprising the CDRH1 amino acid sequence of Seq ID No:405, the CDRH2 amino acid sequence of Seq ID No:406, and the CDRH3 amino acid sequence of Seq ID No:407. The heavy chain nucleic acid sequence of the $V_H$ domain is Seq ID No:409 or Seq ID No:521. STIM003 has a light chain variable region ($V_L$) amino acid sequence of Seq ID No:415, comprising the CDRL1 amino acid sequence of Seq ID No:412, the CDRL2 amino acid sequence of Seq ID No:413, and the CDRL3 amino acid sequence of Seq ID No:414. The light chain nucleic acid sequence of the $V_L$ domain is Seq ID No:4416. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:410 (heavy chain nucleic acid sequence Seq ID No:411 or Seq ID No:522). A full length light chain amino acid sequence is Seq ID No:417 (light chain nucleic acid sequence Seq ID No:418).

STIM004 has a heavy chain variable region ($V_H$) amino acid sequence of Seq ID No:422, comprising the CDRH1 amino acid sequence of Seq ID No:419, the CDRH2 amino acid sequence of Seq ID No:420, and the CDRH3 amino acid sequence of Seq ID No:421. The heavy chain nucleic acid sequence of the $V_H$ domain is Seq ID No:423. STIM004 has a light chain variable region ($V_L$) amino acid sequence of Seq ID No:429, comprising the CDRL1 amino acid sequence of Seq ID No:426, the CDRL2 amino acid sequence of Seq ID No:427, and the CDRL3 amino acid sequence of Seq ID No:428. The light chain nucleic acid sequence of the $V_L$ domain is Seq ID No:430 or Seq ID No:431. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:424 (heavy chain nucleic acid sequence Seq ID No:425). A full length light chain amino acid sequence is Seq ID No:432 (light chain nucleic acid sequence Seq ID No:433 or Seq ID no: 434).

STIM005 has a heavy chain variable region ($V_H$) amino acid sequence of Seq ID No:438, comprising the CDRH1 amino acid sequence of Seq ID No:435, the CDRH2 amino acid sequence of Seq ID No:436, and the CDRH3 amino acid sequence of Seq ID No:437. The heavy chain nucleic acid sequence of the $V_H$ domain is Seq ID No:439. STIM005 has a light chain variable region ($V_L$) amino acid sequence of Seq ID No:445, comprising the CDRL1 amino acid sequence of Seq ID No:442, the CDRL2 amino acid sequence of Seq ID No:443, and the CDRL3 amino acid sequence of Seq ID No:444. The light chain nucleic acid sequence of the $V_L$ domain is Seq ID No:446. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:440 (heavy chain nucleic acid sequence Seq ID No:441). A full length light chain amino acid sequence is Seq ID No:447 (light chain nucleic acid sequence Seq ID No:448).

STIM006 has a heavy chain variable region ($V_H$) amino acid sequence of Seq ID No:452, comprising the CDRH1 amino acid sequence of Seq ID No:449, the CDRH2 amino acid sequence of Seq ID No:450, and the CDRH3 amino acid sequence of Seq ID No:451. The heavy chain nucleic acid sequence of the $V_H$ domain is Seq ID No:453. STIM006 has a light chain variable region ($V_L$) amino acid sequence of Seq ID No:459, comprising the CDRL1 amino acid sequence of Seq ID No:456, the CDRL2 amino acid sequence of Seq ID No:457, and the CDRL3 amino acid sequence of Seq ID No:458. The light chain nucleic acid sequence of the $V_L$ domain is Seq ID No:460. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:454 (heavy chain nucleic acid sequence Seq ID No:455). A full length light chain amino acid sequence is Seq ID No:461 (light chain nucleic acid sequence Seq ID No:462).

STIM007 has a heavy chain variable region ($V_H$) amino acid sequence of Seq ID No:466, comprising the CDRH1 amino acid sequence of Seq ID No:463, the CDRH2 amino acid sequence of Seq ID No:464, and the CDRH3 amino acid sequence of Seq ID No:465. The heavy chain nucleic acid sequence of the $V_H$ domain is Seq ID No:467. STIM007 has a light chain variable region ($V_L$) amino acid sequence of Seq ID No:473, comprising the CDRL1 amino acid sequence of Seq ID No:470, the CDRL2 amino acid sequence of Seq ID No:471, and the CDRL3 amino acid sequence of Seq ID No:472. The light chain nucleic acid sequence of the $V_L$ domain is Seq ID No:474. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:468 (heavy chain nucleic acid sequence Seq ID No:469). A full length light chain amino acid sequence is Seq ID No:475 (light chain nucleic acid sequence Seq ID No:476).

STIM008 has a heavy chain variable region ($V_H$) amino acid sequence of Seq ID No:480, comprising the CDRH1 amino acid sequence of Seq ID No:477, the CDRH2 amino acid sequence of Seq ID No:478, and the CDRH3 amino acid sequence of Seq ID No:479. The heavy chain nucleic acid sequence of the $V_H$ domain is Seq ID No:481. STIM008 has a light chain variable region ($V_L$) amino acid sequence of Seq ID No:487, comprising the CDRL1 amino acid sequence of Seq ID No:484, the CDRL2 amino acid sequence of Seq ID No:485, and the CDRL3 amino acid sequence of Seq ID No:486. The light chain nucleic acid sequence of the $V_L$ domain is Seq ID No:488. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:482 (heavy chain nucleic acid sequence Seq ID No:483). A full length light chain amino acid sequence is Seq ID No:489 (light chain nucleic acid sequence Seq ID No:490).

STIM009 has a heavy chain variable region ($V_H$) amino acid sequence of Seq ID No:494, comprising the CDRH1 amino acid sequence of Seq ID No:491, the CDRH2 amino acid sequence of Seq ID No:492, and the CDRH3 amino acid sequence of Seq ID No:493. The heavy chain nucleic acid sequence of the $V_H$ domain is Seq ID No:495. STIM009 has a light chain variable region ($V_L$) amino acid sequence of Seq ID No:501, comprising the CDRL1 amino acid sequence of Seq ID No:498, the CDRL2 amino acid sequence of Seq ID No:499, and the CDRL3 amino acid sequence of Seq ID No:500. The light chain nucleic acid sequence of the $V_L$ domain is Seq ID No:502. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:496 (heavy chain nucleic acid sequence Seq ID No:497). A full length light chain amino acid sequence is Seq ID No:503 (light chain nucleic acid sequence Seq ID No:504).

Antibodies STIM001-009 are described in more detail in GB patent application 1620414.1 (filed 1 Dec. 2016), the contents of which are incorporated herein by reference. ICOS antibodies may also be described as in the following numbered sentences below: Sentence 1. An isolated antibody that binds the extracellular domain of human and/or mouse ICOS, comprising:

an antibody $V_H$ domain comprising complementarity determining regions (CDRs) HCDR1, HCDR2 and HCDR3, and an antibody $V_L$ domain comprising complementarity determining regions LCDR1, LCDR2 and LCDR3, wherein HCDR1 is the HCDR1 of STIM001, STIM002, STIM002-B, STIM003, STIM004, STIM005, STIM006, STIM007, STIM008 or STIM009, or comprises that HCDR1 with 1, 2, 3, 4 or 5 amino acid alterations, HCDR2 is the HCDR2 of STIM001, STIM002, STIM002-B, STIM003, STIM004, STIM005, STIM006, STIM007, STIM008 or STIM009, or comprises that HCDR2 with 1, 2, 3, 4 or 5 amino acid alterations, and/or HCDR3 is the HCDR3 of STIM001, STIM002, STIM002-B, STIM003, STIM004, STIM005, STIM006, STIM007, STIM008 or STIM009 or comprises that HCDR3 with 1, 2, 3, 4 or 5 amino acid alterations.

Sentence 2. An antibody according to sentence 1, wherein the antibody heavy chain CDRs are those of STIM001, STIM002, STIM002-B, STIM003, STIM004, STIM005, STIM006, STIM007, STIM008 or STIM009 or comprise the STIM001, STIM002, STIM002-B, STIM003, STIM004, STIM005, STIM006, STIM007, STIM008 or STIM009 heavy chain CDRs with 1, 2, 3, 4 or 5 amino acid alterations.

Sentence 3. An antibody according to sentence 2, wherein the antibody $V_H$ domain has the heavy chain CDRs of STIM003.

Sentence 4. An isolated antibody that binds the extracellular domain of human and/or mouse ICOS, comprising:

an antibody $V_H$ domain comprising complementarity determining regions HCDR1, HCDR2 and HCDR3, and an antibody $V_L$ domain comprising complementarity determining regions LCDR1, LCDR2 and LCDR3, wherein LCDR1 is the LCDR1 of STIM001, STIM002, STIM002-B, STIM003, STIM004 STIM005, STIM006, STIM007, STIM008 or STIM009, or comprises that LCDR1 with 1, 2, 3, 4 or 5 amino acid alterations, LCDR2 is the LCDR2 of STIM001, STIM002, STIM002-B, STIM003, STIM004, STIM005, STIM006, STIM007, STIM008 or STIM009, or comprises that LCDR2 with 1, 2, 3, 4 or 5 amino acid alterations, and/or LCDR3 is the LCDR3 of STIM001, STIM002, STIM002-B, STIM003, STIM004, STIM005, STIM006, STIM007, STIM008 or STIM009 or comprises that LCDR3 with 1, 2, 3, 4 or 5 amino acid alterations.

Sentence 5. An antibody according to any preceding sentence, wherein the antibody light chain CDRs are those of STIM001, STIM002, STIM002-B, STIM003, STIM004, STIM005, STIM006, STIM007, STIM008 or STIM009, or comprise the STIM001, STIM002, STIM002-B, STIM003, STIM004, STIM005, STIM006, STIM007, STIM008 or STIM009 light chain CDRs with 1, 2, 3, 4 or 5 amino acid alterations.

Sentence 6. An antibody according to sentence 5, wherein the antibody $V_L$ domain has the light chain CDRs of STIM003.

Sentence 7. An antibody according to any of the preceding sentences, comprising $V_H$ and/or $V_L$ domain framework regions of human germline gene segment sequences.

Sentence 8. An antibody according to any of the preceding sentences, comprising a $V_H$ domain which (i) is derived from recombination of a human heavy chain V gene segment, a human heavy chain D gene segment and a human heavy chain J gene segment, wherein the V segment is IGHV1-18 (e.g., V1-18*01), IGVH3-20 (e.g. V3-20*d01), IGVH3-11 (e.g, V3-11*01) or IGVH2-5 (e.g., V2-5*10);

the D gene segment is IGHD6-19 (e.g., IGHD6-19*01), IGHD3-10 (e.g., IGHD3-10*01) or IGHD3-9 (e.g., IGHD3-9*01); and/or the J gene segment is IGHJ6 (e.g., IGHJ6*02), IGHJ4 (e.g., IGHJ4*02) or IGHJ3 (e.g., IGHJ3*02), or (ii) comprises framework regions FR1, FR2, FR3 and FR4, wherein FR1 aligns with human germline V gene segment IGHV1-18 (e.g., V1-18*01), IGVH3-20 (e.g. V3-20*d01), IGVH3-11 (e.g, V3-11*01) or IGVH2-5 (e.g., V2-5*10), optionally with 1, 2, 3, 4 or 5 amino acid alterations, FR2 aligns with human germline V gene segment IGHV1-18 (e.g., V1-18*01), IGVH3-20 (e.g. V3-20*d01), IGVH3-11 (e.g, V3-11*01) or IGVH2-5 (e.g., V2-5*10), optionally with 1, 2, 3, 4 or 5 amino acid alterations, FR3 aligns with human germline V gene segment IGHV1-18 (e.g., V1-18*01), IGVH3-20 (e.g. V3-20*d01), IGVH3-11 (e.g, V3-11*01) or IGVH2-5 (e.g., V2-5*10), optionally with 1, 2, 3, 4 or 5 amino acid alterations, and/or FR4 aligns with human germline J gene segment IGJH6 (e.g., JH6*02), IGJH4 (e.g., JH4*02) or IGJH3 (e.g., JH3*02), optionally with 1, 2, 3, 4 or 5 amino acid alterations.

Sentence 9. An antibody according to any of the preceding sentences, comprising an antibody $V_L$ domain which (i) is derived from recombination of a human light chain V gene segment and a human light chain J gene segment, wherein the V segment is IGKV2-28 (e.g., IGKV2-28*01), IGKV3-20 (e.g., IGKV3-20*01), IGKV1D-39 (e.g., IGKV1D-39*01) or IGKV3-11 (e.g., IGKV3-11*01), and/or the J gene segment is IGKJ4 (e.g., IGKJ4*01), IGKJ2 (e.g., IGKJ2*04), IGLJ3 (e.g., IGKJ3*01) or IGKJ1 (e.g., IGKJ1*01); or (ii) comprises framework regions FR1, FR2, FR3 and FR4, wherein FR1 aligns with human germline V gene segment IGKV2-28 (e.g., IGKV2-28*01), IGKV3-20 (e.g., IGKV3-20*01), IGKV1D-39 (e.g., IGKV1D-39*01) or IGKV3-11 (e.g., IGKV3-11*01), optionally with 1, 2, 3, 4 or 5 amino acid alterations, FR2 aligns with human germline V gene segment IGKV2-28 (e.g., IGKV2-28*01), IGKV3-20 (e.g., IGKV3-20*01), IGKV1D-39 (e.g., IGKV1D-39*01) or IGKV3-11 (e.g., IGKV3-11*01), optionally with 1, 2, 3, 4 or 5 amino acid alterations, FR3 aligns with human germline V gene segment IGKV2-28 (e.g., IGKV2-28*01), IGKV3-20 (e.g., IGKV3-20*01), IGKV1D-39 (e.g., IGKV1D-39*01) or IGKV3-11 (e.g., IGKV3-11*01), optionally with 1, 2, 3, 4 or 5 amino acid alterations, and/or FR4 aligns with human germline J gene segment IGKJ4 (e.g., IGKJ4*01), IGKJ2 (e.g., IGKJ2*04), IGKJ3 (e.g., IGKJ3*01) or IGKJ1 (e.g., IGKJ1*01), optionally with 1, 2, 3, 4 or 5 amino acid alterations.

Sentence 10. An antibody according to any of the preceding sentences, comprising an antibody $V_H$ domain which is the $V_H$ domain of STIM001, STIM002, STIM002-B, STIM003, STIM004, STIM005, STIM006, STIM007, STIM008 or STIM009, or which has an amino acid sequence at least 90% identical to the antibody VH domain sequence of STIM001, STIM002, STIM002-B, STIM003, STIM004, STIM005, STIM006, STIM007, STIM008 or STIM009.

Sentence 11. An antibody according to any of the preceding sentences, comprising an antibody $V_L$ domain which is the $V_L$ domain of STIM001, STIM002, STIM002-B, STIM003, STIM004, STIM005, STIM006, STIM007, STIM008 or STIM009, or which has an amino acid sequence at least 90% identical to the antibody VL domain sequence of STIM001, STIM002, STIM002-B, STIM003, STIM004, STIM005, STIM006, STIM007, STIM008 or STIM009.

Sentence 12. An antibody according to sentence 11, comprising
an antibody $V_H$ domain which is selected from the VH domain of STIM001, STIM002, STIM002-B, STIM003, STIM004, STIM005, STIM006, STIM007, STIM008 or STIM009, or which has an amino acid sequence at least 90% identical to the antibody VH domain sequence of STIM001, STIM002, STIM002-B, STIM003, STIM004, STIM005, STIM006, STIM007, STIM008 or STIM009, and
an antibody $V_L$ domain which is the $V_L$ domain of said selected antibody, or which has an amino acid sequence at least 90% identical to the antibody $V_L$ domain sequence of said selected antibody.

Sentence 13. An antibody according to sentence 12, comprising the STIM003 $V_H$ domain and the STIM003 $V_L$ domain.

Sentence 14. An antibody according to any of the preceding sentences, comprising an antibody constant region.

Sentence 15. An antibody according to sentence 14, wherein the constant region comprises a human heavy and/or light chain constant region.

Sentence 16. An antibody according to sentence 14 or sentence 15, wherein the constant region is Fc effector positive.

Sentence 17. An antibody according to sentence 16, comprising an Fc region that has enhanced ADCC, ADCP and/or CDC function compared with a native human Fc region.

Sentence 18. An antibody according to any of sentences 14 to 17, wherein the antibody is an IgG1.

Sentence 19. An antibody according to sentence 17 or sentence 18, wherein the antibody is afucosylated.

Sentence 20. An antibody according to any of the preceding sentences which is conjugated to a cytotoxic drug or pro-drug.

Sentence 21. An antibody according to any of the preceding sentences, which is a multispecific antibody.

Sentence 22. An isolated antibody that competes for binding to human ICOS with a human IgG1 antibody comprising the heavy and light chain complementarity determining regions of STIM001, STIM002, STIM002-B, STIM003, STIM004, STIM005, STIM006, STIM007, STIM008 or STIM009.

Sentence 23. An isolated antibody that binds the extracellular domain of human and mouse ICOS with an affinity (KD) of less than 50 nM as determined by surface plasmon resonance.

Sentence 24. An antibody according to sentence 23, wherein the antibody binds the extracellular domain of human and mouse ICOS with an affinity (KD) of less than 5 nM as determined by surface plasmon resonance.

Sentence 25. An antibody according to sentence 23 or sentence 24, wherein the KD of binding the extracellular domain of human ICOS is within 10-fold of the KD of binding the extracellular domain of mouse ICOS.

Sentence 26. A composition comprising an isolated antibody according to any of the preceding sentences and a pharmaceutically acceptable excipient.

Sentence 27. A composition comprising isolated nucleic acid encoding an antibody according to any of sentences 1 to 25 and a pharmaceutically acceptable excipient.

Sentence 28. A method of depleting regulatory T-cells and/or increasing effector T-cell response in a patient comprising administering a composition according to sentence 26 to the patient.

Sentence 29. A method of treating a disease or condition amenable to therapy by depleting regulatory T-cells and/or increasing effector T-cell response in a patient, the method comprising administering a composition according to sentence 26 to the patient.

Sentence 30. A composition according to sentence 26 for use in a method of treatment of the human body by therapy.

Sentence 31. A composition for use according to sentence 30, for use in depleting regulatory T-cells and/or increasing effector T-cell response in a patient.

Sentence 32. A composition for use according to sentence 30, for use in treating a disease or condition amenable to therapy by depleting regulatory T-cells and/or increasing effector T-cell response in a patient.

Sentence 33. A method according to sentence 29, or a composition for use according to sentence 32, wherein the disease is a cancer or a solid tumour.

Sentence 34. A method or a composition for use according to any of sentences 29 to 33, wherein the method comprises administering the antibody and another therapeutic agent to the patient.

Sentence 35. A method or composition for use according to sentence 34, wherein the therapeutic agent is an anti-PDL1 antibody.

Sentence 36. A method or composition for use according to sentence 35, wherein the anti-ICOS antibody and the anti-PDL1 antibody are each able to mediate ADCC, ADCP and/or CDC.

Sentence 37. A method or composition for use according to sentence 35, wherein the anti-ICOS antibody is a human IgG1 antibody and the anti-PDL1 antibody is a human IgG1 antibody.

Sentence 38. A method or composition for use according to sentence 34, wherein the other therapeutic agent is IL-2.

Sentence 39. A method or composition for use according to any of sentences 34 to 38, wherein the method comprises administering the anti-ICOS antibody after administering the other therapeutic agent.

Sentence 40. A method or a composition for use according to any of sentences 28 to 39, wherein
the anti-ICOS antibody is conjugated to a pro-drug, and wherein
the method or use comprises
administering the anti-ICOS antibody to a patient and selectively activating the pro-drug at a target tissue site.

Sentence 41. A method or a composition for use according to sentence 40, wherein the patient has a solid tumour and the method comprises selectively activating the pro-drug in the tumour.

Sentence 42. A method or a composition for use according to sentence 40 or sentence 41, comprising selectively activating the pro-drug through photoactivation.

Sentence 43. Combination of anti-ICOS human IgG1 antibody and anti-PDL1 human IgG1 antibody for use in a method of treating cancer.

Sentence 44. Combination according to sentence 43, wherein the anti-ICOS antibody and the anti-PDL1 antibody are provided in separate compositions for administration.

Sentence 45. A method or composition for use according to sentence 37, or a combination according to sentence 43 or sentence 44, wherein the human IgG1 constant region has a wild type amino acid sequence shown in the appended sequence listing.

Sentence 46. Anti-ICOS antibody for use in a method of reducing or reversing a surge in ICOS-positive regulatory T-cells in a patient, wherein the surge results from treatment of the patient with another therapeutic agent.

Sentence 47. A method of treating a patient, the method comprising reducing or reversing a surge in ICOS-positive regulatory T-cells in the patient, wherein the surge results from treatment of the patient with another therapeutic agent.

Sentence 48. Anti-ICOS antibody for use in a method of treating a patient, the method comprising comprising administering the anti-ICOS antibody to a patient who has an increased level of ICOS-positive regulatory T-cells following treatment with another therapeutic agent.

Sentence 49. A method of treating a patient, the method comprising administering an anti-ICOS antibody to a patient who has an increased level of ICOS-positive regulatory T-cells following treatment with another therapeutic agent.

Sentence 50. An anti-ICOS antibody for use according to sentence 46 or sentence 48, or a method according to sentence 47 or sentence 49, wherein the method comprises administering a therapeutic agent to the patient, determining that the patient has an increased level of ICOS-positive regulatory T-cells following the treatment with said agent, and administering an anti-ICOS antibody to the patient to reduce the level of regulatory T-cells.

Sentence 51. An anti-ICOS antibody for use or a method according to any of sentences 46 to 50, wherein the therapeutic agent is IL-2 or an immunomodulatory antibody (e.g., anti-PDL-1, anti-PD-1 or anti-CTLA-4).

Sentence 52. An anti-ICOS antibody for use or a method according to any of sentences 46 to 51, wherein the method comprises treating a tumour, e.g., melanoma, such as metastatic melanoma.

Sentence 53. Anti-ICOS antibody for use in a method of treating cancer in a patient by in vivo vaccination of the patient against their cancer cells, the method comprising
    treating the patient with a therapy that causes immunological cell death of the cancer cells, resulting in presentation of antigen to antigen-specific effector T-cells, and
    administering an anti-ICOS antibody to the patient, wherein the anti-ICOS antibody enhances the antigen-specific effector T-cell response.

Sentence 54. A method of treating cancer in a patient by in vivo vaccination of the patient against their cancer cells, the method comprising
    treating the patient with a therapy that causes immunological cell death of the cancer cells, resulting in presentation of antigen to antigen-specific effector T-cells, and
    administering an anti-ICOS antibody to the patient, wherein the anti-ICOS antibody enhances the antigen-specific effector T-cell response.

Sentence 55. A method of treating cancer in a patient by in vivo vaccination of the patient against their cancer cells, the method comprising administering an anti-ICOS antibody to the patient, wherein
    the patient is one who has been previously treated with a therapy that causes immunological cell death of the cancer cells, resulting in presentation of antigen to antigen-specific effector T-cells, and wherein
    the anti-ICOS antibody enhances the antigen-specific effector T-cell response.

Sentence 56. Anti-ICOS antibody for use or a method according to any of sentences 53 to 55, wherein the therapy that causes immunological cell death is radiation of the cancer cells, administration of a chemotherapeutic agent and/or administration of an antibody directed to a tumour-associated antigen.

Sentence 57. Anti-ICOS antibody for use or a method according to sentence 56, wherein the chemotherapeutic agent is oxaliplatin.

Sentence 58. Anti-ICOS antibody for use or a method according to sentence 56, wherein the tumour-associated antigen is HER2 or CD20.

Sentence 59. Anti-ICOS antibody for use in a method of vaccinating a patient, the method comprising administering the antibody and a vaccine composition to the patient.

Sentence 60. A method of vaccinating a patient, the method comprising administering an anti-ICOS antibody and a vaccine composition to the patient.

Sentence 61. Anti-ICOS antibody for use according to sentence 59, or a method according to sentence 60, wherein the vaccine composition is a vaccine against hepatitis B, malaria or HIV.

Sentence 62. Anti-ICOS antibody for use in a method of treating a cancer in a patient, wherein the cancer is or has been characterised as being positive for expression of ICOS ligand and/or FOXP3.

Sentence 63. A method of treating a cancer in a patient, wherein the cancer is or has been characterised as being positive for expression of ICOS ligand and/or FOXP3, the method comprising administering an anti-ICOS antibody to the patient.

Sentence 64. Anti-ICOS antibody for use according to sentence 62, or a method according to sentence 63, wherein the method comprises:
    testing a sample from a patient to determine that the cancer expresses ICOS ligand and/or FOXP3;
    selecting the patient for treatment with the anti-ICOS antibody; and
    administering the anti-ICOS antibody to the patient.

Sentence 65. Anti-ICOS antibody for use according to sentence 62, or a method according to sentence 63, wherein the method comprises administering an anti-ICOS antibody to a patient from whom a test sample has indicated that the cancer is positive for expression of ICOS ligand and/or FOXP3.

Sentence 66. Anti-ICOS antibody for use or a method according to sentence 64 or sentence 65, wherein the sample is biopsy sample of a solid tumour.

Sentence 67. Anti-ICOS antibody for use in a method of treating a cancer in a patient, wherein the cancer is or has been characterised as being refractory to treatment with an immunooncology drug, e.g., anti-CTLA-4 antibody, anti-PD1 antibody, anti-PD-L1 antibody, anti-CD137 antibody or anti-GITR antibody.

Sentence 68. A method of treating a cancer in a patient, wherein the cancer is or has been characterised as being refractory to treatment with an immunooncology drug, e.g., anti-CTLA-4 antibody, anti-PD1 antibody, anti-PD-L1 antibody, anti-CD137 antibody or anti-GITR antibody, the method comprising administering an anti-ICOS antibody to the patient.
Sentence 69. Anti-ICOS antibody for use according to sentence 67 or a method according to sentence 68, wherein the method comprises:
   treating the patient with the immunooncology drug;
   determining that the cancer is not responsive to the drug;
   selecting the patient for treatment with the anti-ICOS antibody; and
   administering the anti-ICOS antibody to the patient.
Sentence 70. Anti-ICOS antibody for use according to sentence 67, or a method according to sentence 68, wherein the method comprises administering an anti-ICOS antibody to a patient whose cancer was not responsive to prior treatment with the immunooncology drug.
Sentence 71. Anti-ICOS antibody for use or a method according to any of sentences 62 to 70, wherein the cancer is a tumour derived from cells that have acquired ability to express ICOS ligand.
Sentence 72. Anti-ICOS antibody for use or a method according to sentence 71, wherein the cancer is melanoma.
Sentence 73. Anti-ICOS antibody for use or a method according to any of sentences 62 to 70, wherein the cancer is derived from an antigen-presenting cell, such as a B lymphocyte (e.g., B cell lymphoma, such as diffused large B cell lymphoma) or a T lymphocyte.
Sentence 74. Anti-ICOS antibody for use or a method according to any of sentences 62 to 70, wherein the cancer is resistant to treatment with an anti-CD20 antibody.
Sentence 75. Anti-ICOS antibody for use or a method according to sentence 74, wherein the cancer is B cell lymphoma.
Sentence 76. Anti-ICOS antibody for use or a method according to sentence 75, wherein the anti-CD20 antibody is rituximab.
Sentence 77. Anti-ICOS antibody for use or a method according to any of sentences 74 to 76, wherein the method comprises treating the patient with the anti-CD20 antibody;
   determining that the cancer is not responsive to the anti-CD20 antibody;
   testing a sample from a patient to determine that the cancer expresses ICOS ligand;
   selecting the patient for treatment with the anti-ICOS antibody; and
   administering the anti-ICOS antibody to the patient.
Sentence 78. Anti-ICOS antibody for use or a method according to any of sentences 74 to 76, wherein the method comprises administering an anti-ICOS antibody to a patient whose cancer was not responsive to prior treatment with anti-CD20 antibody.
Sentence 79. Anti-ICOS antibody for use or a method according to any of sentences 52 to 78, wherein the cancer is a solid tumour.
Sentence 80. Anti-ICOS antibody for use or a method according to any of sentences 52 to 78, wherein the cancer is a haemotological liquid tumour.
Sentence 81. Anti-ICOS antibody for use or a method according to sentence 79 or 80, wherein the tumour is high in regulatory T-cells.
Sentence 82. Anti-ICOS antibody for use or a method according to any of sentences 43 to 81, wherein the anti-ICOS antibody is as defined in any of sentences 1 to 25 or is provided in a composition according to sentence 26.
Sentence 83. A transgenic non-human mammal having a genome comprising a human or humanised immunoglobulin locus encoding human variable region gene segments, wherein the mammal does not express ICOS.
Sentence 84. A method of producing an antibody that binds the extracellular domain of human and non-human ICOS, comprising
   (a) immunising a mammal according to sentence 83 with human ICOS antigen;
   (b) isolating antibodies generated by the mammal;
   (c) testing the antibodies for ability to bind human ICOS and non-human ICOS; and
   (d) selecting one or more antibodies that binds both human and non-human ICOS.
Sentence 85. A method according to sentence 84, comprising immunising the mammal with cells expressing human ICOS.
Sentence 86. A method according to sentence 84 or sentence 85, comprising
   (c) testing the antibodies for ability to bind human ICOS and non-human ICOS using surface plasmon resonance and determining binding affinities; and
   (d) selecting one or more antibodies for which the KD of binding to human ICOS is less than 50 nM and the KD of binding to non-human ICOS is less than 500 nM.
Sentence 87. A method according to sentence 86, comprising
   (d) selecting one or more antibodies for which the KD of binding to human ICOS is less than 10 nM and the KD of binding to non-human ICOS is less than 100 nM.
Sentence 88. A method according to any of sentences 84 to 87, comprising
   (c) testing the antibodies for ability to bind human ICOS and non-human ICOS using surface plasmon resonance and determining binding affinities; and
   (d) selecting one or more antibodies for which the KD of binding to human ICOS is within 10-fold of the KD of binding to non-human ICOS.
Sentence 89. A method according to sentence 88, comprising
   (d) selecting one or more antibodies for which the KD of binding to human ICOS is within 5-fold of the KD of binding to non-human ICOS.
Sentence 90. A method according to any of sentences 84 to 89, comprising testing the antibodies for ability to bind non-human ICOS from the same species as the mammal.
Sentence 91. A method according to any of sentences 84 to 90, comprising testing the antibodies for ability to bind non-human ICOS from a different species as the mammal.
Sentence 92. A method according to any of sentences 84 to 91, wherein the mammal is a mouse or a rat.
Sentence 93. A method according to any of sentences 84 to 92, wherein the non-human ICOS is mouse ICOS or rat ICOS.
Sentence 94. A method according to any of sentences 84 to 93, wherein the human or humanised immunoglobulin locus comprises human variable region gene segments upstream of an endogenous constant region.
Sentence 95. A method according to sentence 94, comprising
(a) immunising a mammal according to sentence 83 with human ICOS antigen, wherein the mammal is a mouse;
(b) isolating antibodies generated by the mouse;
(c) testing the antibodies for ability to bind human ICOS and mouse ICOS; and
(d) selecting one or more antibodies that binds both human and mouse ICOS.
Sentence 96. A method according to any of sentences 84 to 95, comprising isolating nucleic acid encoding an antibody heavy chain variable domain and/or an antibody light chain variable domain.

Sentence 97. A method according to any of sentences 84 to 96, wherein the mammal generates antibodies through recombination of human variable region gene segments and an endogenous constant region.

Sentence 98. A method according to sentence 96 or sentence 97, comprising conjugating the nucleic acid encoding the heavy and/or light chain variable domain to a nucleotide sequence encoding a human heavy chain constant region and/or human light chain constant region respectively.

Sentence 99. A method according to any of sentences 96 to 98, comprising introducing the nucleic acid into a host cell.

Sentence 100. A method according to sentence 99, comprising culturing the host cell under conditions for expression of the antibody, or of the antibody heavy and/or light chain variable domain.

Sentence 101. An antibody, or antibody heavy and/or light chain variable domain, produced by the method according to any of sentences 84 to 100.

Sentence 102. A method of selecting an antibody that binds ICOS, optionally for selecting an ICOS agonist antibody, the assay comprising:
- providing an array of antibodies immobilised (attached or adhered) to a substrate in a test well;
- adding ICOS-expressing cells (e.g., activated primary T-cells, or MJ cells) to the test well; observing morphology of the cells;
- detecting shape change in the cells from rounded to flattened against the substrate within the well; wherein the shape change indicates that the antibody is an antibody that binds ICOS, optionally an ICOS agonist antibody;
- selecting the antibody from the test well;
expressing nucleic acid encoding the CDRs of the selected antibody; and
formulating the antibody into a composition comprising one or more additional components.

Alternative sentences describing anti-ICOS antibodies are described below:

Sentence 1a. An antibody or a fragment thereof which specifically binds to human ICOS (hICOS) (SEQ ID NO: 508, 507 and/or 506), and:
  a) competes for binding to said hICOS with the antibody STIM001, wherein the antibody or fragment comprises a $V_H$ domain which comprises the CDRH3 sequence of SEQ ID NO:365, or the CDRH3 sequence of SEQ ID NO:365 comprising 3, 2 or 1 amino acid substitution(s);
  b) competes for binding to said hICOS with the antibody STIM002, wherein the antibody or fragment comprises a $V_H$ domain which comprises the CDRH3 sequence of SEQ ID NO:379, or the CDRH3 sequence of SEQ ID NO:379 comprising 3, 2 or 1 amino acid substitution(s);
  c) competes for binding to said hICOS with the antibody STIM002-B, wherein the antibody or fragment comprises a $V_H$ domain which comprises the CDRH3 sequence of SEQ ID NO:393, or the CDRH3 sequence of SEQ ID NO:393 comprising 3, 2 or 1 amino acid substitution(s);
  d) competes for binding to said hICOS with the antibody STIM003, wherein the antibody or fragment comprises a $V_H$ domain which comprises the CDRH3 sequence of SEQ ID NO:407, or the CDRH3 sequence of SEQ ID NO:407 comprising 3, 2 or 1 amino acid substitution(s);
  e) competes for binding to said hICOS with the antibody STIM004, wherein the antibody or fragment comprises a $V_H$ domain which comprises the CDRH3 sequence of SEQ ID NO:421, or the CDRH3 sequence of SEQ ID NO:421 comprising 3, 2 or 1 amino acid substitution(s);
  f) competes for binding to said hICOS with the antibody STIM005, wherein the antibody or fragment comprises a $V_H$ domain which comprises the CDRH3 sequence of SEQ ID NO:437, or the CDRH3 sequence of SEQ ID NO:437 comprising 3, 2 or 1 amino acid substitution(s);
  g) competes for binding to said hICOS with the antibody STIM006, wherein the antibody or fragment comprises a $V_H$ domain which comprises the CDRH3 sequence of SEQ ID NO:451, or the CDRH3 sequence of SEQ ID NO:451 comprising 3, 2 or 1 amino acid substitution(s);
  h) competes for binding to said hICOS with the antibody STIM007, wherein the antibody or fragment comprises a $V_H$ domain which comprises the CDRH3 sequence of SEQ ID NO:465, or the CDRH3 sequence of SEQ ID NO:465 comprising 3, 2 or 1 amino acid substitution(s);
  i) competes for binding to said hICOS with the antibody STIM008, wherein the antibody or fragment comprises a $V_H$ domain which comprises the CDRH3 sequence of SEQ ID NO:479, or the CDRH3 sequence of SEQ ID NO:479 comprising 3, 2 or 1 amino acid substitution(s); or
  j) competes for binding to said hICOS with the antibody STIM009, wherein the antibody or fragment comprises a $V_H$ domain which comprises the CDRH3 sequence of SEQ ID NO:493, or the CDRH3 sequence of SEQ ID NO:493 comprising 3, 2 or 1 amino acid substitution(s).

Sentence 2a. The antibody or a fragment thereof according to sentence 1a, wherein the $V_H$ domain comprises the CDRH1 sequence of:
  a) SEQ ID NO:363, or the CDRH1 sequence of SEQ ID NO:363 comprising 1 amino acid substitution;
  b) SEQ ID NO:377, or the CDRH1 sequence of SEQ ID NO:377 comprising 1 amino acid substitution;
  c) SEQ ID NO:391, or the CDRH1 sequence of SEQ ID NO:391 comprising 1 amino acid substitution;
  d) SEQ ID NO:405, or the CDRH1 sequence of SEQ ID NO:405 comprising 1 amino acid substitution;
  e) SEQ ID NO:419, or the CDRH1 sequence of SEQ ID NO:419 comprising 1 amino acid substitution;
  f) SEQ ID NO:435, or the CDRH1 sequence of SEQ ID NO:435 comprising 1 amino acid substitution;
  g) SEQ ID NO:449, or the CDRH1 sequence of SEQ ID NO:449 comprising 1 amino acid substitution;
  h) SEQ ID NO:463, or the CDRH1 sequence of SEQ ID NO:463 comprising 1 amino acid substitution; or
  i) SEQ ID NO:477, or the CDRH1 sequence of SEQ ID NO:477 comprising 1 amino acid substitution.
  j) SEQ ID NO:491, or the CDRH1 sequence of SEQ ID NO:491 comprising 1 amino acid substitution.

Sentence 3a. The antibody or a fragment thereof according to sentence 1a or sentence 2a, wherein the $V_H$ domain comprises the CDRH2 sequence of:
  a) SEQ ID NO:364, or the CDRH2 sequence of SEQ ID NO:364 comprising 2 or 1 amino acid substitution(s);
  b) SEQ ID NO:378, or the CDRH2 sequence of SEQ ID NO:378 comprising 2 or 1 amino acid substitution(s);
  c) SEQ ID NO:392, or the CDRH2 sequence of SEQ ID NO:392 comprising 2 or 1 amino acid substitution(s);

d) SEQ ID NO:406, or the CDRH2 sequence of SEQ ID NO:406 comprising 2 or 1 amino acid substitution(s);
e) SEQ ID NO:420, or the CDRH2 sequence of SEQ ID NO:420 comprising 2 or 1 amino acid substitution(s);
f) SEQ ID NO:436, or the CDRH2 sequence of SEQ ID NO:436 comprising 2 or 1 amino acid substitution(s);
g) SEQ ID NO:450, or the CDRH2 sequence of SEQ ID NO:450 comprising 2 or 1 amino acid substitution(s);
h) SEQ ID NO:464, or the CDRH2 sequence of SEQ ID NO:464 comprising 2 or 1 amino acid substitution(s);
i) SEQ ID NO:478, or the CDRH2 sequence of SEQ ID NO:478 comprising 2 or 1 amino acid substitution(s); or
j) SEQ ID NO:492, or the CDRH2 sequence of SEQ ID NO:492 comprising 2 or 1 amino acid substitution(s).

Sentence 4a. The antibody or a fragment thereof according to any preceding sentence, wherein the $V_H$ domain comprises:
a) an amino acid sequence of SEQ ID NO:366, or a heavy chain variable domain amino acid sequence that is at least 98% identical to SEQ ID NO:366;
b) an amino acid sequence of SEQ ID NO:380, or a heavy chain variable domain amino acid sequence that is at least 98% identical to SEQ ID NO:380;
c) an amino acid sequence of SEQ ID NO:394, or a heavy chain variable domain amino acid sequence that is at least 98% identical to SEQ ID NO:394;
d) an amino acid sequence of SEQ ID NO:408, or a heavy chain variable domain amino acid sequence that is at least 98% identical to SEQ ID NO:408;
e) an amino acid sequence of SEQ ID NO:422, or a heavy chain variable domain amino acid sequence that is at least 98% identical to SEQ ID NO:422;
f) an amino acid sequence of SEQ ID NO:438, or a heavy chain variable domain amino acid sequence that is at least 98% identical to SEQ ID NO:438;
g) an amino acid sequence of SEQ ID NO:452, or a heavy chain variable domain amino acid sequence that is at least 98% identical to SEQ ID NO:452;
h) an amino acid sequence of SEQ ID NO:466, or a heavy chain variable domain amino acid sequence that is at least 98% identical to SEQ ID NO:466;
i) an amino acid sequence of SEQ ID NO:480, or a heavy chain variable domain amino acid sequence that is at least 98% identical to SEQ ID NO:480; or
j) an amino acid sequence of SEQ ID NO:494, or a heavy chain variable domain amino acid sequence that is at least 98% identical to SEQ ID NO:494.

Sentence 5a. The antibody or fragment according to any preceding sentence comprising first and second copies of said $V_H$ domain.

Sentence 6a. The antibody or a fragment thereof according to any preceding sentence comprising a $V_L$ domain, which comprises the CDRL1 sequence of:
a) SEQ ID NO:370, or the CDRL1 sequence of SEQ ID NO:370 comprising one amino acid substitution;
b) SEQ ID NO:384, or the CDRL1 sequence of SEQ ID NO:384 comprising one amino acid substitution;
c) SEQ ID NO:398, or the CDRL1 sequence of SEQ ID NO:398 comprising one amino acid substitution;
d) SEQ ID NO:412, or the CDRL1 sequence of SEQ ID NO:412 comprising one amino acid substitution;
e) SEQ ID NO:426, or the CDRL1 sequence of SEQ ID NO:426 comprising one amino acid substitution;
f) SEQ ID NO:442, or the CDRL1 sequence of SEQ ID NO:442 comprising one amino acid substitution;
g) SEQ ID NO:456, or the CDRL1 sequence of SEQ ID NO:456 comprising one amino acid substitution;
h) SEQ ID NO:470, or the CDRL1 sequence of SEQ ID NO:470 comprising one amino acid substitution; or
i) SEQ ID NO:484, or the CDRL1 sequence of SEQ ID NO:484 comprising one amino acid substitution.
j) SEQ ID NO:498, or the CDRL1 sequence of SEQ ID NO:498 comprising one amino acid substitution.

Sentence 7a. The antibody or a fragment thereof according to any preceding sentence comprising a or said $V_L$ domain, which $V_L$ domain comprises the CDRL2 sequence of:
a) SEQ ID NO:371, or the CDRL2 sequence of SEQ ID NO:371 comprising 1 amino acid substitution;
b) SEQ ID NO:385, or the CDRL2 sequence of SEQ ID NO:385 comprising 1 amino acid substitution;
c) SEQ ID NO:399, or the CDRL2 sequence of SEQ ID NO:399 comprising 1 amino acid substitution;
d) SEQ ID NO:413, or the CDRL2 sequence of SEQ ID NO:413 comprising 1 amino acid substitution;
e) SEQ ID NO:427, or the CDRL2 sequence of SEQ ID NO:427 comprising 1 amino acid substitution;
f) SEQ ID NO:443, or the CDRL2 sequence of SEQ ID NO:443 comprising 1 amino acid substitution;
g) SEQ ID NO:457, or the CDRL2 sequence of SEQ ID NO:457 comprising 1 amino acid substitution;
h) SEQ ID NO:471, or the CDRL2 sequence of SEQ ID NO:471 comprising 1 amino acid substitution;
i) SEQ ID NO:485, or the CDRL2 sequence of SEQ ID NO:485 comprising 1 amino acid substitution; or
j) SEQ ID NO:499, or the CDRL2 sequence of SEQ ID NO:499 comprising 1 amino acid substitution.

Sentence 8a. The antibody or a fragment thereof according to any preceding sentence comprising a or said $V_L$ domain, which $V_L$ domain comprises the CDRL3 sequence of:
a) SEQ ID NO:372, or the CDRL3 sequence of SEQ ID NO:372 comprising 2 or 1 amino acid substitution(s);
b) SEQ ID NO:386, or the CDRL3 sequence of SEQ ID NO:386 comprising 2 or 1 amino acid substitution(s);
c) SEQ ID NO:400, or the CDRL3 sequence of SEQ ID NO:400 comprising 2 or 1 amino acid substitution(s);
d) SEQ ID NO:414, or the CDRL3 sequence of SEQ ID NO:414 comprising 2 or 1 amino acid substitution(s);
e) SEQ ID NO:428, or the CDRL3 sequence of SEQ ID NO:428 comprising 2 or 1 amino acid substitution(s);
f) SEQ ID NO:444, or the CDRL3 sequence of SEQ ID NO:444 comprising 2 or 1 amino acid substitution(s);
g) SEQ ID NO:458, or the CDRL3 sequence of SEQ ID NO:458 comprising 2 or 1 amino acid substitution(s);
h) SEQ ID NO:472, or the CDRL3 sequence of SEQ ID NO:472 comprising 2 or 1 amino acid substitution(s);
i) SEQ ID NO:486, or the CDRL3 sequence of SEQ ID NO:486 comprising 2 or 1 amino acid substitution(s); or
j) SEQ ID NO:500, or the CDRL3 sequence of SEQ ID NO:500 comprising 2 or 1 amino acid substitution(s).

Sentence 9a. The antibody or a fragment thereof according to any preceding sentence, comprising a or said $V_L$ domain, wherein the $V_L$ domain comprises an amino acid sequence of:
a) SEQ ID NO:373, or a light chain variable domain amino acid sequence that is at least 98% identical to SEQ ID NO:373;
b) SEQ ID NO:387, or a light chain variable domain amino acid sequence that is at least 98% identical to SEQ ID NO:387;

c) SEQ ID NO:401, or a light chain variable domain amino acid sequence that is at least 98% identical to SEQ ID NO:401;
d) SEQ ID NO:415, or a light chain variable domain amino acid sequence that is at least 98% identical to SEQ ID NO:415;
e) SEQ ID NO:429, or a light chain variable domain amino acid sequence that is at least 98% identical to SEQ ID NO:429;
f) SEQ ID NO:445, or a light chain variable domain amino acid sequence that is at least 98% identical to SEQ ID NO:445;
g) SEQ ID NO:459, or a light chain variable domain amino acid sequence that is at least 98% identical to SEQ ID NO:459;
h) SEQ ID NO:473, or a light chain variable domain amino acid sequence that is at least 98% identical to SEQ ID NO:473;
i) SEQ ID NO:487, or a light chain variable domain amino acid sequence that is at least 98% identical to SEQ ID NO:487; or
j) SEQ ID NO:501, or a light chain variable domain amino acid sequence that is at least 98% identical to SEQ ID NO:501.

Sentence 10a. The antibody or fragment according to any one of sentences 6a to 9a, comprising first and second copies of the a or said $V_L$ domain.

Sentence 11. The antibody or fragment according to any preceding sentence, wherein the amino acid substitutions are conservative amino acid substitutions, optionally wherein the conservative substitutions are from one of six groups (each group containing amino acids that are conservative substitutions for one another) selected from:
1) Alanine (A), Serine (S), Threonine (T);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V); and
6) Phenylalanine (F), Tyrosine (Y), Tryptophan (W).

Sentence 12a. An antibody or fragment thereof which specifically binds to an epitope that is:
a) Identical to an epitope to which the antibody STIM001 specifically binds;
b) Identical to an epitope to which the antibody STIM002 specifically binds;
c) Identical to an epitope to which the antibody STIM002-B specifically binds;
d) Identical to an epitope to which the antibody STIM003 specifically binds;
e) Identical to an epitope to which the antibody STIM004 specifically binds;
f) Identical to an epitope to which the antibody STIM005 specifically binds;
g) Identical to an epitope to which the antibody STIM006 specifically binds;
h) Identical to an epitope to which the antibody STIM007 specifically binds;
i) Identical to an epitope to which the antibody STIM008 specifically binds; or
j) Identical to an epitope to which the antibody STIM009 specifically binds.

Sentence 13a. The antibody or fragment according to sentence 12a, wherein the epitope is identified by unrelated amino acid scanning, or by X-ray crystallography.

Sentence 14a. The antibody or fragment according to sentence 13a, wherein the contact residues of the epitope are defined by a reduction in affinity of at least 10-fold in an unrelated amino acid scan, e.g. an alanine scan as determined by SPR.

Sentence 15a. An antibody or fragment thereof which:
a) Competes for binding to hICOS with the antibody STIM001;
b) Competes for binding to hICOS with the antibody STIM002;
c) Competes for binding to hICOS with the antibody STIM002-B;
d) Competes for binding to hICOS with the antibody STIM003;
e) Competes for binding to hICOS with the antibody STIM004;
f) Competes for binding to hICOS with the antibody STIM005;
g) Competes for binding to hICOS with the antibody STIM006;
h) Competes for binding to hICOS with the antibody STIM007;
i) Competes for binding to hICOS with the antibody STIM008; or
j) Competes for binding to hICOS with the antibody STIM009.

Sentence 16a. The antibody or fragment according to any preceding sentence which specifically binds to cynomolgus ICOS (Seq ID No:513, Seq ID NO: 513 or Seq ID No: 514) and/or mouse ICOS (Seq ID No:510, Seq ID No:511 or Seq ID No:512).

Sentence 17a. The antibody or fragment according to any preceding sentence which specifically binds to a hICOS isoform or natural variant, a mouse ICOS isoform or natural variant and/or a cynomolgus ICOS isoform or natural variant.

Sentence 18a. The antibody or fragment according to sentence 17a, wherein the hICOS isoform comprises an amino acid sequence as defined by Seq ID no:509.

Sentence 19a. The antibody or fragment according to any preceding sentence, wherein the antibody or fragment comprises a constant region, such as a human constant region, for example an effector-null human constant region, e.g. an IgG4 constant region or an IgG1 constant region, optionally wherein the constant region is IgG4-PE (Seq ID No:199), or a disabled IgG1 (Seq ID No:205).

Sentence 20a. The antibody or fragment according to sentence 19a, wherein the constant region is a murine constant region.

Sentence 21a. The antibody or fragment according to sentence 19a or sentence 20a, wherein the constant region has CDC and/or ADCC activity.

5. Anti-ICOS Bispecific Antibodies

As previously described, the PD-L1 antibodies as provided herein, may be formatted as a multispecific (e.g. bispecific) antibody, as disclosed hereinabove in concepts 37 to 40. In one embodiment disclosed therein, the PD-L1 antibodies as disclosed herein may be formatted in a bispecific antibody which has specificity for both PD-L1 (e.g. human PD-L1) and for ICOS (e.g. an agonist to ICOS, such as human ICOS).

Thus, there is provided a multispecific (e.g. bispecific antibody or a dual-binding antibody) which has specificity for PD-L1 (e.g. human PD-L1) and ICOS (e.g. human ICOS). In one embodiment the multispecific (e.g. bispecific or dual-binding) antibody has agonistic activity against ICOS (e.g. human ICOS).

Various ICOS-containing mutispecific antibodies are described in the arrangements below: Arrangement 1. A multispecific antibody (e.g. bispecific antibody or a dual-binding antibody) which binds (and optionally has specificity for) ICOS (e.g. human ICOS) and another target antigen.

In one embodiment, there is provided a bispecific antibody or a dual-binding antibody which binds ICOS (e.g. human ICOS) and another target antigen. In one embodiment, there is provided a bispecific antibody or a dual-binding antibody which has specificity for ICOS (e.g. human ICOS) and another target antigen. In one embodiment, there is provided a bispecific antibody antibody which binds ICOS (e.g. human ICOS) and another target antigen, and wherein the bispecific antibody format is a mAb$^2$. In one embodiment, there is provided a bispecific antibody antibody which binds ICOS (e.g. human ICOS) and another target antigen, and wherein the bispecific antibody format is a mAb$^2$, and the binding to another target antigen is provided by a modified constant region (i.e. an Fcab). In one embodiment, there is provided a bispecific antibody antibody which binds ICOS (e.g. human ICOS) and another target antigen which is PD-L1 (e.g. human PD-L1), and wherein the bispecific antibody format is a mAb2, and the binding to ICOS is provided by a modified constant region (i.e. an Fcab). In one embodiment, there is provided a bispecific antibody antibody which binds ICOS (e.g. human ICOS) and another target antigen which is PD-L1 (e.g. human PD-L1), and wherein the bispecific antibody format is a mAb2, and the binding to ICOS is provided by a modified constant region (i.e. an Fcab) and the binding to PD-L1 is provided by any of the antibodies described in concepts 1 to 70, or by any of the PD-L1 antibodies described in arrangement 5 or 5a below. In one embodiment, there is provided a bispecific antibody antibody which binds ICOS (e.g. human ICOS) and another target antigen which is PD-L1 (e.g. human PD-L1), and wherein the bispecific antibody format is a mAb$^2$, and the binding to PD-L1 is provided by a modified constant region (i.e. an Fcab). In one embodiment, there is provided a bispecific antibody antibody which binds ICOS (e.g. human ICOS) and another target antigen which is PD-L1 (e.g. human PD-L1), and wherein the bispecific antibody format is a mAb$^2$, and the binding to PD-L1 is provided by a modified constant region (i.e. an Fcab) and the binding to ICOS is provided by any of the antibodies described in sentences 1 to 102 or sentences ia to 21a.

In one embodiment, the multispecific (e.g. bispecific or dual-binding) antibody has agonistic activity against ICOS (e.g. human ICOS). The another target antigen may be any of the target antigens specified in concept 39. In one embodiment, the another target antigen is an immune checkpoint inhibitor, such as PD-1, PD-L1, CTLA-4, TIGIT, TIM-3, LAG-3 and VISTA, e.g. PD-L1, TIGIT, CTLA-4, TIM-3 and LAG-3. In one embodiment, the another target antigen is an immune modulator, such as BTLA, hHVEM, CSF1R, CCR4, CD39, CD40, CD73, CD96, CXCR2, CXCR4, CD200, GARP, SIRPα, CXCL9, CXCL10 and CD155, e.g. GARP, SIRPα, CXCR4, BTLA, hVEM and CSF1R. In one embodiment, the another target antigen is an immune activator, such as CD137, GITR, OX40, CD40, CXCR3 (e.g. agonistic anti-CXCR3 antibodies), CD27 and CD3, or CD137, GITR, OX40, CD40, CXCR3 (e.g. agonistic anti-CXCR3 antibodies) and CD3, for example CD137, GITR and OX40). In one embodiment, the another target antigen is PD-L1. In one embodiment, the another target antigen is CTLA-4. In one embodiment, the another target antigen is TIGIT. In one embodiment, the another target antigen is TIM-3. In one embodiment, the another target antigen is LAG-3. In one embodiment, the another target antigen is GITR. In one embodiment, the another target antigen is VISTA. In one embodiment, the another target antigen is CD137. In one embodiment, the another target antigen is SIRPα. In one embodiment, the another target antigen is CXCL10. In one embodiment, the another target antigen is CD155. In one embodiment, the another target antigen is CD40. The antibodies against these another target antigens may be any of those described in aspect ia hereinabove.

The format of the multispecific, bispecific or dual-binding antibody may be any of the formats disclosed herein, for example as set out in concepts 37 to 40. In particular, the binding and/or specificity for ICOS may be provided by a non-immunoglobulin format, for example, a T-cell receptor binding domain; an immunoglobulin superfamily domain; an agnathan variable lymphocyte receptor; a fibronectin domain (e.g., an Adnectin™); an antibody constant domain (e.g., a CH3 domain, e.g., a CH2 and/or CH3 of an Fcab™) wherein the constant domain is not a functional CH1 domain; an scFv; an (scFv)2; an sc-diabody; an scFab; a centyrin and an epitope binding domain derived from a scaffold selected from CTLA-4 (Evibody™); a lipocalin domain; Protein A such as Z-domain of Protein A (e.g., an Affibody™ or SpA); an A-domain (e.g., an Avimer™ or Maxibody™); a heat shock protein (such as and epitope binding domain derived from GroEI and GroES); a transferrin domain (e.g., a trans-body); ankyrin repeat protein (e.g., a DARPin™); peptide aptamer; C-type lectin domain (e.g., Tetranectin™); human γ-crystallin or human ubiquitin (an affilin); a PDZ domain; scorpion toxin; and a kunitz type domain of a human protease inhibitor. The binding and/or specificity for another target antigen may be provided by an immunoglobulin-dervied antigen-binding protein.

"Specifically binds" has the meaning provided hereinabove. Binding constants, e.g. $K_D$ may be determined as described elsewhere herein, and particular $K_D$S of interest are described in arrangement 2 below, and in concept 1 hereinabove (although specified for PD-L1 binding, the values of $K_D$ may be equally applied to anti-ICOS binding). Arrangement 2. A multispecific antibody according to arrangement 1, wherein the ICOS is human ICOS.

Sequences of human ICOS are provided in Seq ID Nos: 506, 507 and 508. In one embodiment, the multispecific antibody is specific for wild type human ICOS. In another embodiment, the multispecific antibody is cross-reactive to an isoform or natural variant of hICOS, for example the isoform of Seq ID No:509. Other isoforms and natural variants are well known to those skilled in the art. In another embodiment, the multispecific antibody is specific for the isoform or natural variant (e.g. the ICOS isoform having the amino acid sequence of Seq ID No:509) over wild type hICOS.

One way to quantify the extent of species cross-reactivity of an antibody, e.g. a multispecific, bispecific or dual-binding antibody is as the fold-difference in its affinity for antigen compared with a different antigen (e.g. fold difference in affinity for human ICOS vs mouse ICOS or fold difference in affinity for wild-type hICOS vs an isoform of hICOS). Affinity may be quantified as $K_D$, referring to the equilibrium dissociation constant of the antibody-antigen reaction as determined by SPR (optionally with the antibody in Fab format as described elsewhere herein). A species or isoform cross-reactive anti-ICOS antibody may have a fold-difference in affinity for binding human and mouse ICOS that is 30-fold or less, 25-fold or less, 20-fold or less, 15-fold or less, 10-fold or less or 5-fold or less. To put it another way, the $K_D$ of binding the extracellular domain of hICOS may be within 30-fold, 25-fold, 20-fold, 15-fold, 10-fold or 5-fold of the $K_D$ of binding the extracellular domain of mouse ICOS. Antibodies can also be considered cross-reactive if the $K_D$ for binding antigen of both species meets a threshold value, e.g., if the $K_D$ of binding hICOS and the $K_D$ of binding mouse ICOS are both 10 mM or less, preferably 5 mM or less, more preferably 1 mM or less. The $K_D$ may be 10 nM or less, 5 nM or less, 2 nM or less, or 1 nM or less. The $K_D$ may be 0.9 nM or less, 0.8 nM or less, 0.7 nM or less, 0.6 nM or less, 0.5 nM or less, 0.4 nM or less, 0.3 nM or less, 0.2 nM or less, or 0.1 nM or less.

An alternative measure of cross-reactivity for binding hICOS and mouse ICOS, or WT hICOS and an isoform of hICOS is the ability of an antibody to neutralise ICOS ligand binding to ICOS receptor, such as in an HTRF assay (as described elsewhere herein). Examples of species cross-reactive antibodies are provided herein, including STIM001, STIM002, STIM002-B, STIM003, STIM005 and STIM006, each of which was confirmed as neutralising binding of human B7-H2 (ICOS ligand) to hICOS and neutralising binding of mouse B7-H2 to mouse ICOS in an HTRF assay. Any of these antibodies or their variants may be selected when an antibody cross-reactive for human and mouse ICOS is desired. A species cross-reactive anti-ICOS antibody may have an $IC_{50}$ for inhibiting binding of hICOS to human ICOS receptor that is within 25-fold, 20-fold, 15-fold, 10-fold or 5-fold of the IC50 for inhibiting mouse ICOS to mouse ICOS receptor as determined in an HTRF assay. Antibodies can also be considered cross-reactive if the $IC_{50}$ for inhibiting binding of hICOS to human ICOS receptor and the $IC_{50}$ for inhibiting binding of mouse ICOS to mouse ICOS receptor are both 1 mM or less, preferably 0.5 mM or less, e.g., 30 nM or less, 20 nM or less, 10 nM or less. The $IC_{50}$s may be 5 nM or less, 4 nM or less, 3 nM or less or 2 nM or less. In some cases, the $IC_{50}$s will be at least 0.1 nM, at least 0.5 nM or at least 1 nM.

Affinities may also be as disclosed in concept 27 hereinabove.

Arrangement 3. A multispecific antibody according to arrangement 2, which comprises a $V_H$ domain comprising a CDRH1, a CDRH2 and a CDRH3 which $V_H$ domain binds (and optionally has specificity for) hICOS.

In one embodiment, the multispecific antibody comprises at least one $V_H$ domain which binds to hICOS. For example, the multispecific antibody may comprise a single-chain Fv (scFv), single-chain antibody, a single domain antibody or a domain antibody compsiting only the $V_H$ region which binds to (and optionally has specificity for) hICOS.

Arrangement 4. A multispecific antibody according to arrangement 2 or arrangement 3, which comprises a $V_L$ domain comprising a CDRL1, a CDRL2 and a CDRL3, which $V_L$ domain binds (and optionally has specificity for) hICOS.

In one embodiment, the multispecific antibody comprises at least one $V_L$ domain which binds to hICOS. For example, the multispecific antibody may comprise a single-chain Fv (scFv), single-chain antibody, a single domain antibody or a domain antibody compsiting only the $V_L$ region which binds to (and optionally has specificity for) hICOS.

In another embodiment, the multispecific antibody comprises a paired $V_H$ and $V_L$ domain, including, but not limited to, an intact or full-length antibody, a Fab fragment, a Fab' fragment, a F(ab')$_2$ fragment or a Fv fragment.

Arrangement 5. A multispecific antibody according to arrangement 3 or 4, wherein the $V_H$ and/or $V_L$ domain is any of $V_H$ and/or $V_L$ domains:

a. of the antibody 7F12, 37A10, 35A9, 36E10, 16G10, 37A10S713, 37A10S714, 37A10S715, 37A10S716, 37A10S717, 37A10S718, 16G10S71, 16G10S72, 16G10S73, 16G10S83, 35A9S79, 35A9S710, 35A9S89 or any other antibody described in WO2016/154177 and US2016/0304610;
b. of the antibody 422.2, H2L5, or any other antibody described in WO2016/120789 and US2016/0215059;
c. of the antibody 314-8, the antibody produced from hybridoma CNCM I-4180, or any other antibody described in WO2014/033327 and US2015/0239978;
d. of the antibody Icos145-1, the antibody produced by hybridoma CNCM I-4179, or any other antibody described in WO2012/131004, U.S. Pat. No. 9,376,493 and US2016/0264666;
e. of the antibody JMAb 136, "136", or any other antibody described in WO2010/056804;
f. of the antibody MIC-944, 9F3 or any other antibody described in WO99/15553, U.S. Pat. Nos. 7,259,247, 7,132,099, 7,125,551, 7,306,800, 7,722,872, WO05/103086, US8.318.905 and U.S. Pat. No. 8,916,155;
g. of any JMAb antibody, e.g., any of JMAb-124, JMAb-126, JMAb-127, JMAb-128, JMAb-135, JMAb-136, JMAb-137, JMAb-138, JMAb-139, JMAb-140, JMAb-141, e.g., JMAb136, or any other antibody described in WO98/3821, U.S. Pat. No. 7,932,358B2, US2002/156242, U.S. Pat. Nos. 7,030,225, 7,045,615, 7,279, 560, 7,226,909, 7,196,175, 7,932,358, 8,389,690, WO02/070010, U.S. Pat. Nos. 7,438,905, 7,438,905, WO01/87981, U.S. Pat. Nos. 6,803,039, 7,166,283, 7,988,965, WO01/15732, U.S. Pat. Nos. 7,465,445 and 7,998,478;
h. of the antibody 17G9 or any other antibody described in WO2014/08911;
i. of any antibody described in WO2012/174338;
j. of any antibody described in US2016/0145344;
k. of any antibody described in WO2011/020024, US2016/002336, US2016/024211 and U.S. Pat. No. 8,840,889;
l. of any antibody described in U.S. Pat. No. 8,497,244;
m. of the antibody known as GSK3359609;
n. of the antibody known as JTX-2011; or
o. of antibody clone ISA-3 (eBioscience), clone SP98 (Novus Biologicals), clone 1 G1, clone 3G4 (Abnova Corporation), clone 669222 (R&D Systems), clone TQ09 (Creative Diagnostics), or clone C398.4A (BioLegend).

Arrangement 5a. A multispecific antibody according to any preceding arrangement, which comprises the CDRH1, CDRH2, CDR3, CDRL1, CDRL2 and CDRL3, or the $V_H$, or the $V_L$ or the $V_H$ and $V_L$ region:

a. of the antibody 7F12, 37A10, 35A9, 36E10, 16G10, 37A10S713, 37A10S714, 37A10S715, 37A10S716, 37A10S717, 37A10S718, 16G10S71, 16G10S72, 16G10S73, 16G10S83, 35A9S79, 35A9S710, 35A9S89 or any other antibody described in WO2016/154177 and US2016/0304610;
b. of the antibody 422.2, H2L5, or any other antibody described in WO2016/120789 and US2016/0215059;
c. of the antibody 314-8, the antibody produced from hybridoma CNCM I-4180, or any other antibody described in WO2014/033327 and US2015/0239978;
d. of the antibody Icos145-1, the antibody produced by hybridoma CNCM I-4179, or any other antibody described in WO2012/131004, U.S. Pat. No. 9,376,493 and US2016/0264666;

e. of the antibody JMAb 136, "136", or any other antibody described in WO2010/056804;
f. of the antibody MIC-944, 9F3 or any other antibody described in WO99/15553, U.S. Pat. Nos. 7,259,247, 7,132,099, 7,125,551, 7,306,800, 7,722,872, WO05/103086, US8.318.905 and U.S. Pat. No. 8,916,155;
g. of any JMAb antibody, e.g., any of JMAb-124, JMAb-126, JMAb-127, JMAb-128, JMAb-135, JMAb-136, JMAb-137, JMAb-138, JMAb-139, JMAb-140, JMAb-141, e.g., JMAb136, or any other antibody described in WO98/3821, U.S. Pat. No. 7,932,358B2, US2002/156242, U.S. Pat. Nos. 7,030,225, 7,045,615, 7,279,560, 7,226,909, 7,196,175, 7,932,358, 8,389,690, WO02/070010, U.S. Pat. Nos. 7,438,905, 7,438,905, WO01/87981, U.S. Pat. Nos. 6,803,039, 7,166,283, 7,988,965, WO01/15732, U.S. Pat. Nos. 7,465,445 and 7,998,478;
h. of the antibody 17G9 or any other antibody described in WO2014/08911;
i. of any antibody described in WO2012/174338;
j. of any antibody described in US2016/0145344;
k. of any antibody described in WO2011/020024, US2016/002336, US2016/024211 and U.S. Pat. No. 8,840,889;
l. of any antibody described in U.S. Pat. No. 8,497,244;
m. of the antibody known as GSK3359609;
n. of the antibody known as JTX-2011; or
o. of antibody clone ISA-3 (eBioscience), clone SP98 (Novus Biologicals), clone 1 G1, clone 3G4 (Abnova Corporation), clone 669222 (R&D Systems), clone TQ09 (Creative Diagnostics), or clone C398.4A (BioLegend).

Arrangement 6. A multispecific antibody according to arrangement 3 or 4, wherein the $V_H$ and/or $V_L$ domain is any of $V_H$ and/or $V_L$ domains defined in sentences 1 to 102 or sentences 1a to 21a.

In one embodiment, the anti-ICOS $V_H$ and/or $V_L$ is as described in GB patent application 1620414.1 (filed 1 Dec. 2016), the contents of which are incorporated herein by reference.

Arrangement 7. A multispecific antibody according to any preceding arrangement, which has agonistic activity against ICOS.

Agonism can be tested for in an in vitro T-cell activation assays, using antibody in soluble form (e.g. in immunoglobulin format or other antibody format comprising two spatially separated antigen-binding sites, e.g., two $V_H$-$V_L$ pairs), either including or excluding a cross-linking agent, or using antibody (e.g. multispecific antibody) bound to a solid surface to provide a tethered array of antigen-binding sites. Agonism assays may use a hICOS positive T-lymphocyte cell line such as MJ cells (ATCC CRL-8294) as the target T-cell for activation in such assays. One or more measures of T-cell activation can be determined for a test antibody and compared with a reference molecule or a negative control to determine whether there is a statistically significant (p<0.05) difference in T-cell activation effected by the test antibody (e.g. multispecific antibody) compared with the reference molecule or the control. One suitable measure of T-cell activation is production of cytokines, e.g., IFNγ, TNFα or IL-2. A skilled person will include suitable controls as appropriate, standardising assay conditions between test antibody and control. A suitable negative control is an antibody in the same format (e.g., isotype control) that does not bind ICOS, e.g., an antibody (e.g. multispecific antibody) specific for an antigen that is not present in the assay system. A significant difference is observed for test antibody relative to a cognate isotype control within the dynamic range of the assay is indicative that the antibody acts as an agonist of the ICOS receptor in that assay.

An agonist antibody may be defined as one which, when tested in a T-cell activation assay:
has a significantly lower $EC_{50}$ for induction of IFNγ production compared with control antibody;
induces significantly higher maximal IFNγ production compared with control antibody;
has a significantly lower $EC_{50}$ for induction of IFNγ production compared with ICOSL-Fc;
induces significantly higher maximal IFNγ production compared with ICOSL-Fc;
has a significantly lower $EC_{50}$ for induction of IFNγ production compared with reference antibody C398.4A; and/or
induces significantly higher maximal IFNγ production compared with reference antibody C398.4A.

A significantly lower or significantly higher value may for example be up to 0.5-fold different, up to 0.75-fold different, up to 2-fold different, up to 3-fold different, up to 4-fold different or up to 5-fold different, compared with the reference or control value.

Thus, in one example, an antibody (e.g. a multispecific antibody) provided herein has a significantly lower, e.g., at least 2-fold lower, $EC_{50}$ for induction of IFNγ in an MJ cell activation assay using the antibody in bead-bound format, compared with control.

The bead-bound assay uses the antibody (e.g. multispecific antibody) (and, for control or reference experiments, the control antibody, reference antibody or ICOSL-Fc) bound to the surface of beads. Magnetic beads may be used, and various kinds are commercially available, e.g., Tosyl-activated DYNABEADS M-450 (DYNAL Inc, 5 Delaware Drive, Lake Success, N.Y. 11042 Prod No. 140.03, 140.04). Beads may be coated (coating methods are well-known to those skilled in the art), or generally by dissolving the coating material in carbonate buffer (pH 9.6, 0.2 M) or other method known in the art. Use of beads conveniently allows the quantity of protein bound to the bead surface to be determined with a good degree of accuracy. Standard Fc-protein quantification methods can be used for coupled protein quantification on beads. Any suitable method can be used, with reference to a relevant standard within the dynamic range of the assay. DELFIA, ELISA or other methods could be used.

Agonism activity of an antibody can also be measured in primary human T-lymphocytes ex vivo. The ability of an antibody (e.g. multispecific antibody) to induce expression of IFNγ in such T-cells is indicative of ICOS agonism. Preferably, an antibody will show significant (p<0.05) induction of IFNγ at 5 µg/mL compared with control antibody in a T-cell activation assay. An anti-ICOS antibody may stimulate T-cell activation to a greater degree than ICOS-L or C398.4 in such an assay. Thus, the antibody may show significantly (p<0.05) greater induction of IFNγ at 5 µg/mL compared with the control or reference antibody in a T-cell activation assay. TNFα or IL-2 induction may be measured as an alternative assay readout.

Agonism of an anti-ICOS antibody may contribute to its ability to change the balance between populations of $T_{Reg}$ and $T_{Eff}$ cells in vivo, e.g., in a site of pathology such as a tumour microenvironment, in favour of $T_{Eff}$ cells. The ability of an antibody to enhance tumour cell killing by activated ICOS-positive effector T-cells may be determined, as discussed elsewhere herein.

Arrangement 8. A multispecific antibody according to any preceding arrangement, which binds (and optionally has specificity for) mouse ICOS and/or cynomolgus ICOS.

The multispecific antibodies described herein may be cross-reactive, and may for example bind the extracellular domain of mouse ICOS as well as human ICOS. The multispecific antibodies may bind other non-human ICOS, including ICOS of primates, such as cynomolgus monkey. An anti-ICOS multispecific antibody intended for therapeutic use in humans must bind human ICOS, whereas binding to ICOS of other species would not have direct therapeutic relevance in the human clinical context. Regardless of the underlying theory, however, cross-reactive antibodies are of high value and are excellent candidates as therapeutic molecules for pre-clinical and clinical studies. Cross-reactivity may be determined as set out for arrangement 2 hereinabove.

Arrangement 9. A multispecific antibody according to any preceding arrangement which is a bispecific antibody.

A bispecific antibody has any of the meanings set out hereinabove.

Arrangement 10. A bispecifc antibody according to arrangement 9, wherein the bispecific antibody format is selected from DVD-Ig, mAb$^2$, FIT-Ig, mAb-dAb, dock and lock, SEEDbody, scDiabody-Fc, diabody-Fc, tandem scFv-Fc, Fab-scFv-Fc, Fab-scFv, intrabody, BiTE, diabody, DART, TandAb, scDiabody, scDiabody-CH3, Diabody-CH3, minibody, knobs-in-holes, knobs-in-holes with common light chain, knobs-in-holes with common light chain and charge pairs, charge pairs, charge pairs with common light chain, in particular mAb$^2$, knob-in-holes, knob-in-holes with common light chain, knobs-in-holes with common light chain and charge pairs and FIT-Ig, e.g. mAb$^2$ and FIT-Ig.

In one embodiment, the bispecific antibody format is as described in any of concepts 37 to 40 described hereinabove, or as described in the definitions section. In one embodiment, the bispecific antibody format is a mAb$^2$, wherein the ICOS binding is provided by the Fcab portion of the bispecific antibody. In another embodiment, the the bispecific antibody format is a mAb$^2$, wherein the ICOS binding is provided by the Fab portion of the bispecific antibody.

In another embodiment, the bispecific antibody is not a mAb$^2$ bispecific antibody.

Arrangement 11. A multispecific antibody according to any one of arrangements 1 to 8 which is a dual binding antibody.

A dual-binding antibody has any of the meanings set out hereinabove.

Arrangement 12. A multispecific, bispecific or dual binding antibody according to any one of arrangements 1 to 11, wherein the another target antigen is selected from immune checkpoint inhibitors, immune modulators and immune activators.

Arrangement 13. A multispecific, bispecific or dual-binding antibody according to arrangement 12, wherein the another target antigen is selected from PD-1, PD-L1, CTLA-4, TIGIT, TIM-3, LAG-3, VISTA, BTLA, HVEM, CSF1R, CCR4, CD39, CD40, CD73, CD96, CXCR2, CXCR4, CD200, GARP, SIRPα, CXCL9, CXCL10, CD155, CD137, GITR, OX40, CXCR3, CD27 and CD3.

Arrangement 13a. A multispecific, bispecific or dual-binding antibody according to arrangement 12, wherein the another target antigen is selected from PD-1, PD-L1, CTLA-4, TIGIT, TIM-3, LAG-3, VISTA, BTLA, HVEM, CSF1R, CCR4, CD39, CD40, CD73, CD96, CXCR2, CXCR4, CD200, GARP, SIRPα, CXCL9, CXCL10, CD155, CD137, GITR, OX40, CXCR3 and CD3.

In one embodiment, the antigen-binding site which binds the another target antigen is provided for by any of the CDRH1, CDRH2, CDR3, CDRL1, CDRL2 and CDRL3, or the $V_H$, or the $V_L$ or the $V_H$ and $V_L$ regions from any one of the antibodies against the targets listed in arrangement 13 which are described in more detail in aspect ia hereinabove.

Arrangement 14. A multispecific, bispecific or dual-binding antibody according to arrangement 13, wherein the another target antigen is selected from PD-L1, TIGIT, TIM-3, LAG-3, GARP, SIRPα, CXCR4, BTLA, HVEM, CSF1R, agonistic anti-CXCR3 antibodies), CD137, GITR and OX40.

Arrangement 15. A multispecific, bispecific or dual-binding antibody according to arrangement 14, wherein the another target antigen is PD-L1 (e.g. human PD-L1).

Arrangement 16. A multispecific, bispecific or dual-binding antibody according to arrangement 15, wherein the binding (and optionally specificity for) PD-L1 is provided by any of the antibodies or fragments as defined in concepts 1 to 70.

Arrangement 17. A multispecific, bispecific or dual-binding antibody according to arrangement 15 or arrangement 16, which comprises a $V_H$ domain comprising a CDRH1, a CDRH2 and a CDRH3 which $V_H$ domain has specificity for human PD-L1.

Arrangement 18. A multispecific, bispecific or dual-binding antibody according to any one of arrangements 15 to 17, which comprises a $V_L$ domain comprising a CDRL1, a CDRL2 and a CDRL3, which $V_L$ domain as specificity for human PD-L1.

Arrangement 19. A multispecific, bispecific or dual-binding antibody according to arrangement 17 or arrangement 18, wherein the $V_H$ and/or $V_L$ domain is any of $V_H$ and/or $V_L$ domains from atezolizumab (Roche), avelumab (Merck), BMS-936559 (BMS), durvalumab (Medimmune) or from any of the PD-L1 antibodies disclosed in WO2016/061142, WO2016/022630, WO2016/007235, WO2015/173267, WO2015/181342, WO2015/109124, WO2015/112805, WO2015/061668, WO2014/159562, WO2014/165082, WO2014/100079, WO2014/055897, WO2013/181634, WO2013/173223, WO2013/079174, WO2012/145493, WO2011/066389, WO2010/077634, WO2010/036959 or WO2007/005874.

Arrangement 20. A multispecific, bispecific or dual-binding antibody according to arrangement 17 or arrangement 18, wherein the $V_H$ and/or $V_L$ domain is any of $V_H$ and/or $V_L$ domains described in concepts 1 to 70.

Arrangement 21. A multispecific, bispecific or dual-binding antibody according to any one of arrangements 15 to 20, which binds (and optionally has specificity for) mouse PD-L1 and/or cynomolgus PD-L1.

Cross reactivity may be as described hereinabove for arrangement 2 or concept 27.

Arrangement 22. A composition comprising a multispecific, bispecific or dual-binding antibody as defined in any preceding arrangement and a pharmaceutically acceptable excipient, diluent or carrier and optionally further comprising a further therapeutic agent independently selected from the group consisting of:
  a) other immune checkpoint inhibitors (such as anti-TIM-3 antibodies, anti-PD-1 antibodies, anti-CTLA-4 antibodies, anti-TIGIT antibodies and anti-LAG-3 antibodies);
  b) immune stimulators (such as anti-OX40 antibodies, anti-GITR antibodies, anti-CD137 antibodies, anti-ICOS antibodies and anti-CD40 antibodies);
  c) chemokine receptor antagonists (such as CXCR4, CCR4 and CXCR2);
  d) targeted kinase inhibitors (such as CSF-1R or VEGFR inhibitors);

e) angiogenesis inhibitors (such as anti-VEGF-A or Delta-like Ligand-4);
f) immune stimulating peptides or chemokines (such as CXCL9 or CXCL10);
g) cytokines (such as IL-15 and IL-21);
h) bispecific T-cell engagers (BiTEs) having at least one specificity against CD3 (e.g. CD3/CD19 BiTE);
i) other bi-specific molecules (for example IL-15-containing molecules targeted towards tumour associated antigens, for example Epidermal growth factor receptors such as EGFR, Her-2, New York Esophageal Cancer-1 (NY-ESO-1), GD2, EpCAM or Melanoma Associated Antigen-3 (MAGE-A3));
j) oncolytic viruses (such as HSV virus (optionally which secretes GMCSF), Newcastle disease virus and Vaccinia virus);
k) vaccination with tumour associated antigens (such as New York Esophageal Cancer-1 [NY-ESO-1], Melanoma Associated Antigen-3 [MAGE-3]);
l) cell-based therapies (such as chimeric Antigen Receptor-T-cells (CAR-T) for example expressing anti-CD19, anti-EpCam or anti-mesothelin);
m) bi-specific NK cell engagers having a specificity against an activating MK receptor such as NKG2D or CD16a; and
n) adoptive transfer of tumour specific T-cells or LAK cells.

The antibodies may be any of the sequences or antibodies described in arrangement 5 or detailed in aspect 1a. Other features of this arrangement may be as described in concept 49.

Arrangement 22a. A pharmaceutical composition according to arrangement 22, or a kit comprising a pharmaceutical composition as defined in arrangement 22, wherein the composition is for treating and/or preventing a condition or disease selected from neoplastic or non-neoplastic disease, chronic viral infections, and malignant tumours, such as melanoma, Merkel cell carcinoma, non-small cell lung cancer (squamous and non-squamous), renal cell cancer, bladder cancer, head and neck squamous cell carcinoma, mesothelioma, virally induced cancers (such as cervical cancer and nasopharyngeal cancer), soft tissue sarcomas, haematological malignancies such as Hodgkin's and non-Hodgkin's disease, diffuse large B-cell lymphoma.

Arrangement 22b. A pharmaceutical composition according to arrangement 22 or arrangement 22a in combination with, or kit according to arrangement 22a comprising, a label or instructions for use to treat and/or prevent said disease or condition in a human; optionally wherein the label or instructions comprise a marketing authorisation number (e.g., an FDA or EMA authorisation number); optionally wherein the kit comprises an IV or injection device that comprises the multispecific, bispecific or dual-binding antibody.

Arrangement 23. A multispecific, bispecific or dual-binding antibody as defined in any one of arrangements 1 to 21 for use in treating or preventing a disease or condition, selected from neurological disease, neoplastic or non-neoplastic disease, chronic viral infections, and malignant tumours; such as melanoma, Merkel cell carcinoma, non-small cell lung cancer (squamous and non-squamous), renal cell cancer, bladder cancer, head and neck squamous cell carcinoma, mesothelioma, virally induced cancers (such as cervical cancer and nasopharyngeal cancer), soft tissue sarcomas, haematological malignancies such as Hodgkin's and non-Hodgkin's disease and diffuse large B-cell lymphoma (for example melanoma, Merkel cell carcinoma, non-small cell lung cancer (squamous and non-squamous), renal cell cancer, bladder cancer, head and neck squamous cell carcinoma and mesothelioma or for example virally induced cancers (such as cervical cancer and nasopharyngeal cancer) and soft tissue sarcomas).

Arrangement 24. Use of a multispecific, bispecific or dual-binding antibody as defined in any one of arrangements 1 to 21 in the manufacture of a medicament for administration to a human for treating or preventing a disease or condition in the human selected from neurological disease, neoplastic or non-neoplastic disease, chronic viral infections, and malignant tumours, such as melanoma, Merkel cell carcinoma, non-small cell lung cancer (squamous and non-squamous), renal cell cancer, bladder cancer, head and neck squamous cell carcinoma, mesothelioma, virally induced cancers (such as cervical cancer and nasopharyngeal cancer), soft tissue sarcomas, haematological malignancies such as Hodgkin's and non-Hodgkin's disease and diffuse large B-cell lymphoma (for example melanoma, Merkel cell carcinoma, non-small cell lung cancer (squamous and non-squamous), renal cell cancer, bladder cancer, head and neck squamous cell carcinoma and mesothelioma or for example virally induced cancers (such as cervical cancer and nasopharyngeal cancer) and soft tissue sarcomas).

Arrangement 25. A method of treating or preventing a disease or condition selected from neurological disease, neoplastic or non-neoplastic disease, chronic viral infections, and malignant tumours, such as melanoma, Merkel cell carcinoma, non-small cell lung cancer (squamous and non-squamous), renal cell cancer, bladder cancer, head and neck squamous cell carcinoma, mesothelioma, virally induced cancers (such as cervical cancer and nasopharyngeal cancer), soft tissue sarcomas, haematological malignancies such as Hodgkin's and non-Hodgkin's disease and diffuse large B-cell lymphoma (for example melanoma, Merkel cell carcinoma, non-small cell lung cancer (squamous and non-squamous), renal cell cancer, bladder cancer, head and neck squamous cell carcinoma and mesothelioma or for example virally induced cancers (such as cervical cancer and nasopharyngeal cancer) and soft tissue sarcomas) in a human, comprising administering to said human a therapeutically effective amount of a multispecific, bispecific or dual-binding antibody as defined in any one of arrangements 1 to 21, wherein the disease or condition is thereby treated or prevented.

The diseases and conditions which may be treated or prevented by the multispecific, bispecific or dual-binding antibodies provided for in these arrangements may be any of the diseases provided for in, for example concepts 41 to 45, aspects 51 to 55, or in any of the sentences described herein.

Arrangement 26. The multispecific, bispecific or dual-binding antibody according to arrangement 23, the use according to arrangement 24 or the method according to arrangement 25, wherein the neurological disease is a neurodegenerative disease, disorder or condition, optionally wherein the neurodegenerative disease, disorder or condition is selected from Alzheimer's disease, amyotrophic lateral sclerosis, Parkinson's disease, Huntington's disease, primary progressive multiple sclerosis, secondary progressive multiple sclerosis, corticobasal degeneration, Rett syndrome, a retinal degeneration disorder selected from age-related macular degeneration and retinitis pigmentosa; anterior ischemic optic neuropathy, glaucoma, uveitis, depression, trauma-associated stress or post-traumatic stress disorder, frontotemporal dementia, Lewy body dementias, mild cognitive impairments, posterior cortical atrophy, primary progressive aphasia and progressive supranuclear palsy or aged-related dementia, in particular Alzheimer's disease, amyotrophic lateral sclerosis, Parkinson's disease and Huntington's disease, and e.g. Alzheimer's disease.

Arrangement 27. The multispecific, bispecific or dual-binding antibody according to arrangement 23, the use according to arrangement 24 or the method according to arrangement 25, wherein the cancer is selected from melanoma, Merkel cell carcinoma, non-small cell lung cancer (squamous and non-squamous), renal cell cancer, bladder cancer, head and neck squamous cell carcinoma and mesothelioma or is selected from virally induced cancers (such as cervical cancer and nasopharyngeal cancer) and soft tissue sarcomas.

Arrangement 28. The multispecific, bispecific or dual-binding antibody, the use or the method according to any one of arrangements 23 to 27, further comprising administering to the human a further therapy, for example a further therapeutic agent, optionally wherein the further therapeutic agent is independently selected from the group consisting of:
  a. other immune checkpoint inhibitors (such as anti-TIM-3 antibodies, anti-PD-1 antibodies, anti-CTLA-4 antibodies, anti-TIGIT antibodies and anti-LAG-3 antibodies);
  b. immune stimulators (such as anti-OX40 antibodies, anti-GITR antibodies, anti-CD137 antibodies and anti-CD40 antibodies);
  c. chemokine receptor antagonists (such as CXCR4, CCR4 and CXCR2);
  d. targeted kinase inhibitors (such as CSF-1R or VEGFR inhibitors);
  e. angiogenesis inhibitors (such as anti-VEGF-A or Delta-like Ligand-4);
  f. immune stimulating peptides or chemokines (such as CXCL9 or CXCL10);
  g. cytokines (such as IL-15 and IL-21);
  h. bispecific T-cell engagers (BiTEs) having at least one specificity against CD3 (e.g. CD3/CD19 BiTE);
  i. other bi-specific molecules (for example IL-15-containing molecules targeted towards tumour associated antigens, for example Epidermal growth factor receptors such as EGFR, Her-2, New York Esophageal Cancer-1 (NY-ESO-1), GD2, EpCAM or Melanoma Associated Antigen-3 (MAGE-A3));
  j. oncolytic viruses (such as HSV virus (optionally which secretes GMCSF), Newcastle disease virus and Vaccinia virus);
  k. vaccination with tumour associated antigens (such as New York Esophageal Cancer-1 [NY-ESO-1], Melanoma Associated Antigen-3 [MAGE-3]);
  l. cell-based therapies (such as chimeric Antigen Receptor-T-cells (CAR-T) for example expressing anti-CD19, anti-EpCam or anti-mesothelin);
  m. bi-specific NK cell engagers having a specificity against an activating MK receptor such as NKG2D or CD16a; and
  n. adoptive transfer of tumour specific T-cells or LAK cells, or optionally wherein the further therapy is chemotherapy, radiotherapy and surgical removal of tumours.

Radiotherapy may be single dose or in fractionated doses, either delivered to affected tissues directly or to the whole body.

In this arrangement, any of the features and embodiments of concept 46 apply mutatis mutandis.

In this aspect, the bispecific molecules include "bispecific antibodies" and antibody fusion proteins, including those formats and molecules described in concepts 37 to 40.

Arrangement 29. A nucleic acid that encodes a heavy chain and/or a light chain of a multispecific, bispecific or dual-binding antibody as defined in any one of arrangements 1 to 21.

Arrangement 30. A vector comprising the nucleic acid as defined in arrangement 29; optionally wherein the vector is a CHO or HEK293 vector.

Arrangement 31. A host comprising the nucleic acid as defined in arrangement 29 or the vector as defined in arrangement 30.

6. Uses for Antibodies and Immunocytokines

Unless otherwise apparent from the context, the uses for antibodies or fragments applies mutatis mutandis to the immunocytokines and multispecific (e.g. bispecific or dual-binding antibodies) of the invention. Where described in the context of PD-L1 or another target that is not TIGIT, the features in this section 6 apply mutatis mutandis to the TIGIT aspects of the invention in place of PD-L1 or such other target.

Therapeutic

In one embodiment, the PD-L1 specific antibodies described herein and antigen binding fragments thereof can be used for therapeutic modulation of the PD-1/PD-L1 pathway. In one embodiment, the PD-L1 specific antibody or fragment thereof is as described in any concept, aspect or embodiment herein.

In one embodiment, the antibody or antibody binding fragment specifically binds to PD-L1 and thereby inhibits PD-L1 activity. In another embodiment, the antibody or antibody binding fragment specifically binds to PD-L1 and thereby inhibits binding of PD-L1 to PD-1. In another embodiment, the antibody or antibody binding fragment specifically binds to PD-L1 and thereby inhibits binding of PD-L1 to B7-1. In yet another embodiment, the antibody or antigen binding fragment thereof blocks PD-L1 induced T-cell suppression and thereby enhance anti-tumour immunity.

In yet another embodiment, the antibody or antigen binding fragment thereof is capable of stimulating one or more of the following activities: T-cell proliferation, IFN-γ, CD25 and/or IL-2 secretion in mixed lymphocyte reactions.

In one embodiment, the antibody or antigen binding fragment thereof specifically binds PD-L1 and inhibits PD-L1 induced cell proliferation, for example, tumour cell proliferation and/or inhibits tumour cell survival. In another embodiment, the antibody or antigen binding fragment thereof specifically binds PD-L1 and thereby inhibits PD-L1 mediated suppression of T-cells, including, but not limited to, tumour reactive T-cells, thereby enhancing anti-tumour cytolytic T-cell activity. In other embodiments, the antibodies or binding fragments thereof as described herein inhibit tumour cell adhesion, motility, invasion and cellular metastasis, and reduce tumour growth. In other embodiments, the antibodies or binding fragments thereof can bind to cells expressing PD-L1, including tumour and non-tumour cells, and recruit, by means of interaction with the Fc portion of the antibody, cellular effector functions against the target cells by mechanisms including but not limited to antibody dependent cellular cytotoxicity (ADCC) and antibody dependent cellular phagocytosis (ADCP).

Still further embodiments include methods of treating a proliferative or invasion-related disease in a mammal by administering to the animal a therapeutically effective dose of an antibody or antigen binding fragment thereof. In another embodiment, the antibodies or antigen binding fragments thereof can be used in a method for treating a mammal suffering from a disease selected from: neoplastic or non-neoplastic disease, chronic viral infection, and a malignant tumour, wherein the method includes administering to the mammal a therapeutically effective dose of an antibody or antigen binding fragment thereof.

Still further embodiments include methods of treating a disease of immunological dysfunction in a mammal by administering to the animal a therapeutically effective dose of an antibody or antigen binding fragment thereof as described herein. Exemplary immunological dysfunction in humans includes diseases of neurological deficit, such as Alzheimer's disease.

It has further been proposed that an immune response, particularly an IFNγ-dependent systemic immune response, could be beneficial for treatment of Alzheimer's disease and other CNS pathologies that share a neuroinflammatory component. WO2015/136541 (incorporated herein by reference) proposes treatment of Alzheimer's disease using an anti-PD-1 antibody (also see Baruch K. et al., PD-1 immune checkpoint blockade reduces pathology and improves memory in mouse models of Alzheimer's disease, Nature Medicine, 2016, 22(2):137-137).

Thus, in one embodiment, the antibody or antigen binding fragment thereof specifically binds PD-L1 and reduces the level of systemic immunosuppression in an individual by release of a restraint imposed on the immune system by PD-1/PD-L1 immune checkpoint pathway. In an aspect, PD-1/PD-L1 inhibitory immune checkpoint pathway blockade results in transient relief the systemic adaptive immune activity from suppression, which results in a transiently augmented immune response in the periphery, mainly manifested by elevation of IFN-γ secretion by IFN-γ-producing cells. Increased IFN-γ activity may enable the brain's choroid plexus to allow selective leukocyte trafficking and infiltration of T-cells and monocytes into the damaged CNS, homing of these immune cells to sites of neurodegenerative pathology and neuroinflammation, and may modulate the environment to become less toxic and more permissive for clearance of toxic agents, rescue of neurons, regeneration and repair.

Thus, the PD-L1 mediated disease or condition is a neurodegenerative disease, disorder or condition. In one embodiment, the neurodegenerative disease, disorder or condition is Alzheimer's disease. In another embodiment, the neurodegenerative disease, disorder or condition is selected from amyotrophic lateral sclerosis, Parkinson's disease, Huntington's disease, primary progressive multiple sclerosis, secondary progressive multiple sclerosis, corticobasal degeneration, Rett syndrome, a retinal degeneration disorder selected from age-related macular degeneration and retinitis pigmentosa; anterior ischemic optic neuropathy, glaucoma, uveitis, depression, trauma-associated stress or post-traumatic stress disorder, frontotemporal dementia, Lewy body dementias, mild cognitive impairments, posterior cortical atrophy, primary progressive aphasia and progressive supranuclear palsy or aged-related dementia. In another embodiment, the neurodegenerative disease, disorder or condition is selected from Alzheimer's disease, amyotrophic lateral sclerosis, Parkinson's disease and Huntington's disease.

Anti-PD-L1 antibodies as described herein may be used in the treatment of Alzheimer's disease or other neurodegenerative diseases, optionally in combination with one or more other immune checkpoint inhibitors (such as anti-TIM-3 antibodies, anti-CTLA-4 antibodies, anti-TIGIT antibodies and anti-LAG-3 antibodies) or one or more other immune stimulators (such as anti-OX40 antibodies, anti-GITR antibodies, anti-CD137 antibodies, anti-ICOS antibodies and anti-CD40 antibodies, including those which are specifically described in Aspect 1a herein). Other combination partners include any of the the active agents as listed in claim 10 of WO2015/136541, which is incorporated herein by reference.

Any of the PD-L1 antibodies described herein (including at least the antibodies described in any of concepts 1 to 40, and the PD-L1 antibodies described in aspect ia) may be used for the treatment of the neurodegenerative diseases, disorders or conditions described above.

Exemplary cancers in humans include a Merkel cell carcinoma, breast cancer, prostate cancer, basal cell carcinoma, biliary tract cancer, bladder cancer, bone cancer, brain and CNS cancer (e.g. gliomblastoma), cervical cancer, choriocarcinoma, colon and rectum cancer, connective tissue cancer, cancer of the digestive system; endometrial cancer, esophageal cancer; eye cancer; cancer of the head and neck; nasopharyngeal cancer; gastric cancer; intra-epithelial neoplasm; kidney cancer; larynx cancer; leukemia; liver cancer; lung cancer (e.g. small cell and non-small cell); lymphoma including Hodgkin's and Non-Hodgkin's lymphoma including but not limited to DLBCL; Chronic lymphocytic leukaemia, melanoma; uveal melanoma, myeloma, neuroblastoma, oral cavity cancer (e.g., lip, tongue, mouth, and pharynx); ovarian cancer; pancreatic cancer, retinoblastoma; rhabdomyosarcoma; rectal cancer, renal cancer (renal cell carcinoma (RCC)), cancer of the respiratory system; sarcoma, skin cancer; stomach cancer, testicular cancer, thyroid cancer; uterine cancer, cancer of the urinary system, as well as other carcinomas and sarcomas. Further examples of virally induced cancers including; Nasopharyngeal carcinoma, certain Types of NHL (for example but not limited to EBV+CNS lymphomas, DLBCL and BL, Hodgkins lymphoma (thought to be EBV driven) HPV-related cervical and head and neck squamous cell carcinomas); HBV hepatocellular carcinoma.

Exemplary chronic infections in humans include HIV, hepatitis B virus (HBV), and hepatitis C virus (HCV).

Proliferative or invasion-related diseases that can be treated with the antibodies or antigen binding fragments described herein include neoplastic diseases, and the metastasis associated with such neoplastic disease, such as, melanoma, uveal melanoma, skin cancer, small cell lung cancer, non-small cell lung cancer, salivary gland, glioma, hepatocellular (liver) carcinoma, gallbladder cancer, thyroid tumour, bone cancer, gastric (stomach) cancer, prostate cancer, breast cancer (including triple negative breast cancer), ovarian cancer, cervical cancer, uterine cancer, vulval cancer, endometrial cancer, testicular cancer, bladder cancer, lung cancer, glioblastoma, thyroid cancer, endometrial cancer, kidney cancer, colon cancer, colorectal cancer, pancreatic cancer, esophageal carcinoma, brain/CNS cancers, neuronal cancers, head and neck cancers (including but not limited to squamous cell carcinoma of the head and neck (SCCHN)), mesothelioma, sarcomas, biliary (cholangiocarcinoma), small bowel adenocarcinoma, pediatric malignancies, epidermoid carcinoma, sarcomas, cancer of the pleural/peritoneal membranes and leukaemia, including acute myeloid leukaemia, acute lymphoblastic leukaemia, and multiple myeloma. Treatable chronic viral infections include HIV, hepatitis B virus (HBV), and hepatitis C virus (HCV) in humans, simian immunodeficiency virus (SIV) in monkeys, and lymphocytic choriomeningitis virus (LCMV) in mice.

The antibody or antigen binding fragment thereof can be administered alone, or in combination with other antibodies or chemo therapeutic drugs, radiation therapy or therapeutic vaccines. In one embodiment, the antibody or antigen binding fragment thereof is administered as an antibody-drug conjugate in which the antibody or antigen binding fragment thereof is linked to a drug moiety such as a cytotoxic or cytostatic agent. The use of antibody-drug conjugates for the local delivery of cytotoxic or cytostatic agents in the treatment of cancer allows targeted delivery of the drug moiety to tumours, and intracellular accumulation therein, where systemic administration of unconjugated drug may result in unacceptable levels of toxicity. Drugs in antibody drug conjugates can include, but are not limited to, daunomycin, doxorubicin, methotrexate, and vindesine. Toxins can also be used in antibody-toxin conjugates, including, for example, bacterial toxins such as diphtheria toxin, plant toxins such as ricin, small molecule toxins such as geldanamycin. The toxins may effect their cytotoxic and cytostatic effects by mechanisms including tubulin binding, DNA binding, or topoisomerase.

Detection

In another embodiment, the antibodies or antigen binding fragments can be used to detect the presence, absence and/or level of surface expressed PD-L1 expression in a sample. PD-L1 surface expression can be detected in vivo and/or in vitro and is useful in helping diagnose diseases or conditions that involve expression and/or overexpression of PD-L1.

In vitro diagnostic In another embodiment, the PD-L1 specific antibodies or antigen binding fragments thereof can be used for the assessment of expression and localization of PD-L1 in a biological sample from a patient. In one embodiment, the biological sample is a tissue sample and PD-L1 expression is detected using known methods such as FLOW cytometry, IHC in fresh tissue, IHC in FFPE tissue and/or IHC in frozen tissue. In other embodiments, the biological sample is blood, plasma or serum.

In one embodiment, the antibody or antibody fragment described herein is labeled with a detectable moiety, for example, a radiolabel, fluorescent label, enzymatic label chemiluminescent labeled or a biotinyl group. Radioisotopes or radionuclides may include $^3$H, $^{14}$C, $^{15}$N, $^{35}$S, $^{90}$Y, $^{99}$Tc, $^{115}$In, $^{125}$I, $^{131}$I, fluorescent labels may include rhodamine, lanthanide phosphors or FITC and enzymatic labels may include horseradish peroxidase, β-galactosidase, luciferase, alkaline phosphatase. Additional labels include, by way of illustration and not limitation: enzymes, such as glucose-6-phosphate dehydrogenase ("G6PDH"), alpha-D-galactosidase, glucose oxydase, glucose amylase, carbonic anhydrase, acetylcholinesterase, lysozyme, malate dehydrogenase and peroxidase; dyes; additional fluorescent labels or fluorescers include, such as fluorescein and its derivatives, fluorochrome, GFP (GFP for "Green Fluorescent Protein"), dansyl, umbelliferone, phycoerythrin, phycocyanin, allophycocyanin, o-phthaldehyde, and fiuorescamine; fluorophores such as lanthanide cryptates and chelates e.g. Europium etc (Perkin Elmer and Cisbio Assays); chemoluminescent labels or chemiluminescers, such as isoluminol, luminol and the dioxetanes; sensitisers; coenzymes; enzyme substrates; particles, such as latex or carbon particles; metal sol; crystallite; liposomes; cells, etc., which may be further labelled with a dye, catalyst or other detectable group; molecules such as biotin, digoxygenin or 5-bromodeoxyuridine; toxin moieties, such as for example a toxin moiety selected from a group of Pseudomonas exotoxin (PE or a cytotoxic fragment or mutant thereof), Diptheria toxin or a cytotoxic fragment or mutant thereof, a botulinum toxin A, B, C, D, E or F, ricin or a cytotoxic fragment thereof e.g. ricin A, abrin or a cytotoxic fragment thereof, saporin or a cytotoxic fragment thereof, pokeweed antiviral toxin or a cytotoxic fragment thereof and bryodin 1 or a cytotoxic fragment thereof.

In Vivo Diagnostic

In one embodiment, the antibody or antigen binding fragment thereof can be administered to a patient, wherein the antibody or antigen binding fragment is conjugated to a label. The presence of the label in the patient can be measured or observed, wherein a relatively high amount of the label may indicate a high risk of disease and a relatively low amount of the label may indicate a relatively low risk of the disease. In one embodiment, the label is a contrast agent, isotopic tag, or fluorescent marker, such as green fluorescent protein.

In one embodiment, the antibody or antigen binding fragment is used to monitor therapy that involves the use of other therapeutic agents, including, for example, chemotherapeutic agents or other antibodies that specifically bind PD-L1. In one embodiment, the antibody does not compete with the therapeutic PD-L1 antibodies.

Guide Patient Selection

In one embodiment, detection of PD-L1 expression can be used to guide patient selection. In one embodiment, the antibodies or antigen binding fragments thereof can be used to assist in patient selection for therapeutic antibody treatment with an anti-PD-L1 antibody, including, but not limited to anti-PD-L1 antibodies disclosed in WO2011/066389, entitled "Targeted Binding Agents Against B7-H1", which antibodies and sequences are incorporated herein by reference. In another embodiment, the antibodies or antigen binding fragments thereof can be used to assist in patient selection for treatment with immunotherapies such as anti-PD-L1, anti-CTLA4, anti-OX40, anti-PD-1, vaccines etc. In some cases, higher levels of PD-L1 may be indicative of successful therapy, whereas lower levels may indicate a reduced likelihood of success. Preferential expression of splice variants and/or protein processing may produce unique protein mixture profiles which may impact a patient's response to treatment or may change following treatment. These profiles may help to identify patients and define patient subsets who should receive treatment, continue to receive treatment or who should receive an alternative treatment. In another embodiment, the antibodies or antigen binding fragments thereof can be used for detection of PD-L1 isoforms. Patient samples can include, for example, blood, plasma, serum, sputum, saliva, urine, CSF, tears, exhaled exogenous particle samples, cell supernatant, cell or tissue lysate or tissue samples.

In one embodiment, the antibodies or antigen binding fragments thereof can be used to identify the presence, absence and/or level of PD-L1 expression at baseline, i.e., before treatment.

In another embodiment, the PD-L1 specific antibodies or antigen binding fragments thereof can be used as an exclusion marker to suggest treatment with therapies that do not target PD-L1. In another embodiment, the PD-L1 specific antibodies or antigen binding fragments thereof can be used as a prognostic marker for life expectancy. In particular, PD-L1 expression on tumours is linked to poor prognosis and life expectancy can be estimated based on historical data within tumour types.

Methods for detection of proteins are known, and include, for example, IHC, FLOW cytometery, Western blotting and Mass Spectroscopy, Immunoprecipitation, aptamers, immuno-PCR, and protein array.

Guide Therapy

The antibodies can be used to guide therapy. For example, the antibodies or antigen binding fragments thereof can be used to identify the presence, absence and/or level of PD-L1 expression during or after treatment. In one embodiment, the antibodies or antigen binding fragments thereof can be used as early response biomarkers to assist in patient management, drug approval and reimbursement. In another embodiment, the antibodies or antigen binding fragments thereof can be used to identify the presence, absence and/or level of PD-L1 expression to help guide therapy. For example, PD-L1 expression can help determine whether the treatment is effective, and hence, whether or not treatment should be continued, or whether the dose should be adjusted (increased or decreased) and whether a combination regimen should be changed. For example, in one embodiment, the PD-L1 specific antibodies or antigen binding fragments thereof can be used for determining receptor occupancy of PD-L1 on cells in a patient treated with anti-PD-L1 therapy for dose setting (PK/PD). In particular, receptor occupancy can be used as a measure of target engagement or target coverage. Estimates of the amount or duration of target engagement needed to elicit a biological or clinical response could be used to determine if a patient has been dosed sufficiently or not. In particular, the antibodies can be used to assist in evaluating the relationship between, dose, exposure, receptor occupancy, pharmacodynamic response and clinical benefit.

Monitor Efficacy of Therapy

In another embodiment, the PD-L1 specific antibodies or antigen binding fragments thereof can be used for patient monitoring, to help evaluate whether a course of treatment is effective and whether or not treatment should be continued. For example, in one embodiment, the antibodies or antigen binding fragments thereof can be used detect expression before a patient receives therapeutic treatment that targets PD-L1. In another embodiment, the antibodies or antigen binding fragments thereof can be used to detect expression during therapy or after a patient has received therapeutic anti-PD-L1 treatment. In another embodiment, the antibodies or antigen binding fragments thereof can be used as an early response marker to assist in the determination as to whether or not a course of therapy is effective and should be continued or discontinued. In one embodiment, the expression of PD-L1 is detected after washout, wherein the term "washout" refers to a period of time after which the administered drug has been eliminated from the body. In particular, expression of PD-L1 may be detected after washout if the patient is treated with anti-PD-L1 therapy that competes with the detection antibody. However, if the patient is treated with an antibody that does not compete with an anti-PD-L1 antibody, such as anti-CTLA-4 or anti-PD-1, detection can be performed without waiting for washout. In another embodiment, the detection antibody can bind to PD-L1 but not compete with a therapeutic antibody that binds to PD-L1. In this situation, washout may not be necessary. The washout period can vary depending upon many factors, but is generally a period of at least about 1, 2, 3, 4, 5, or 6 weeks and up to about 1, 2, 3, 4, 5 or 6 months from the most recent chemotherapy or immunotherapy treatment. The antibodies or antigen binding fragments thereof can be used to determine expression of PD-L1 on biopsy samples or on circulating tumour cells (CTC).

In one embodiment, labelled antibodies or antigen binding fragments thereof can be used to identify a peripheral correlate to enable non-invasive assessment of tumour status pre, during and post treatment.

Methods for detection of proteins are known, and include, for example, IHC, flow cytometery, Western blotting and Mass Spectroscopy, immunoprecipitation, aptamers, immuno-PCR., and protein array.

Identify Protein Binding Partners for PD-L1

In another embodiment, antibodies or antigen binding fragments thereof can be used as a capture reagent or detection reagent for examination of the protein binding partners of PD-L1 protein species in the context of a protein "pull-down." A protein "pull down" refers to immunoprecipitation of intact protein complexes, such as antigen along with any proteins or ligands that are bound to it—also known as co-immunoprecipitation (Co-IP). Co-IP works by selecting an antibody that targets a known protein that is believed to be a member of a larger complex of proteins. By targeting the known member with an antibody it may become possible to pull the entire protein complex out of solution and thereby identify unknown members of the complex. Complete understanding of the regulation of immune recognition through and PD-1 axis vs. CTLA-4 etc. is not fully understood. As such, antibodies and antigen binding fragments could improve knowledge of the interplay among accessory proteins and factors, which may determine a patient's propensity to respond to specific therapies or immunotherapy in general.

7. Pharmaceutical Compositions

Unless otherwise apparent from the context, the compositions for antibodies or fragments applies mutatis mutandis to the immunocytokines and multispecific (e.g. bispecific or dual-binding antibodies) of the invention. Where described in the context of PD-L1 or another target that is not TIGIT, the features in this section 7 apply mutatis mutandis to the TIGIT aspects of the invention in place of PD-L1 or such other target.

In one embodiment, there is provided a pharmaceutical composition comprising an effective amount of an antibody or antigen binding fragment and a pharmaceutically acceptable carrier. An effective amount of antibody to be employed therapeutically will depend, for example, upon the therapeutic objectives, the route of administration, and the condition of the patient. In one embodiment, the composition includes other excipients or stabilizers.

Pharmaceutically acceptable carriers are known and include carriers, excipients, or stabilizers that are nontoxic to the cell or mammal being exposed thereto at the dosages and concentrations employed. Often the physiologically acceptable carrier is an aqueous pH buffered solution. Examples of physiologically acceptable carriers include buffers such as phosphate, citrate, and other organic acids; antioxidants including ascorbic acid; low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as Ethylenediaminetetraacetic acid (EDTA); sugar alcohols such as mannitol or sorbitol; salt-forming counterions such as sodium; and/or nonionic surfactants such as TWEEN™, polyethylene glycol (PEG), and PLURONICS™.

The antibodies or antigen binding fragments can be administered intravenously or through the nose, lung, for example, as a liquid or powder aerosol (lyophilized). The composition can also be administered parenterally or subcutaneously. When administered systemically, the composition should be sterile, pyrogen-free and in a physiologically acceptable solution having due regard for pH, isotonicity and stability. These conditions are known to those skilled in the art.

Methods of administering a prophylactic or therapeutic agent (e.g., an antibody as disclosed herein), or pharmaceutical composition include, but are not limited to, parenteral administration (e.g., intradermal, intramuscular, intraperitoneal, intravenous and subcutaneous), epidural, and mucosal (e.g., intranasal and oral routes). In a specific embodiment, a prophylactic or therapeutic agent (e.g., an antibody as disclosed herein), or a pharmaceutical composition is administered intranasally, intramuscularly, intravenously, or subcutaneously. The prophylactic or therapeutic agents, or compositions may be administered by any convenient route, for example by infusion or bolus injection, by absorption through epithelial or mucocutaneous linings (e.g., oral mucosa, intranasal mucosa, rectal and intestinal mucosa, etc.) and may be administered together with other biologically active agents. Administration can be systemic or local. Each dose may or may not be administered by an identical route of administration. In one embodiment, an anti-PD-L1 antibody or fragment as disclosed herein may be administered via multiple routes of administration simultaneously or subsequently to other doses of the same or a different anti-PD-L1 antibody or fragment as disclosed herein.

Various delivery systems are known and can be used to administer a prophylactic or therapeutic agent (e.g., an antibody or fragment as disclosed herein), including, but not limited to, encapsulation in liposomes, microparticles, microcapsules, recombinant cells capable of expressing the antibody, receptor-mediated endocytosis (see, e.g., Wu and Wu, J. Biol. Chem. 262:4429-4432 (1987)), construction of a nucleic acid as part of a retroviral or other vector, etc. In addition, pulmonary administration can also be employed, e.g., by use of an inhaler or nebulizer, and formulation with an aerosolizing agent. See, e.g., U.S. Pat. Nos. 6,019,968, 5,985,320, 5,985,309, 5,934,272, 5,874,064, 5,855,913, 5,290,540, and 4,880,078; and PCT Publication Nos. WO92/19244, WO97/32572, WO97/44013, WO98/31346, and WO99/66903, each of which is incorporated herein by reference their entirety.

In a specific embodiment, it may be desirable to administer a prophylactic or therapeutic agent, or a pharmaceutical composition as described herein locally to the area in need of treatment. This may be achieved by, for example, local infusion, by topical administration (e.g., by intranasal spray), by injection, or by means of an implant, said implant being of a porous, non-porous, or gelatinous material, including membranes, such as silastic membranes, or fibres. When administering an anti-PD-L1 antibody or fragment, care must be taken to use materials to which the antibody does not absorb.

8. Kits and Articles of Manufacture

Unless otherwise apparent from the context, the kits and articles of manufacture for antibodies or fragments applies mutatis mutandis to the immunocytokines and multispecific (e.g. bispecific or dual-binding antibodies) of the invention. Where described in the context of PD-L1 or another target that is not TIGIT, the features in this section 8 apply mutatis mutandis to the TIGIT aspects of the invention in place of PD-L1 or such other target.

In one embodiment, the invention provides a kit for detecting PD-L1 in a biological sample. The kit can be used to screen for PD-L1 related diseases. In one embodiment, the kit includes an antibody or antigen binding fragment and a means for determining whether the antibody or antigen binding fragment is bound to PD-L1 in a sample. In one embodiment, the antibody or antigen binding fragment is labelled. In another embodiment, the antibody or antigen binding fragment is an unlabelled primary antibody and the kit includes means for detecting the primary antibody. In one embodiment, the means for detecting includes a labelled secondary antibody that is an anti-immunoglobulin antibody. The antibody may be labelled with any suitable marker, including, for example, a fluorochrome, an enzyme, a radionuclide and a radiopaque material. Suitable antibodies and antigen binding fragments are described in detail above.

In one embodiment, a kit for detecting PD-L1 is provided, wherein the kit includes an antibody or antigen binding fragment described herein. In one embodiment, the kit may also include instructions and one or more reagents for detecting PD-L1. In one embodiment, the kit includes an antigen or antigen binding fragment described herein, along with instructions for preparing a formalin-fixed paraffin-embedded (FFPE) tissue sample for IHC and/or one or more reagents for IHC. In one embodiment, the kit includes an antigen or antigen binding fragment described herein as a primary antibody and a secondary antibody that specifically binds thereto. In one embodiment, the kit includes a labeled antigen or antigen binding fragment described herein, wherein the label includes a fluorescent label such as fluoroscein or rhodamine or an enzymatic reporter such as horseradish peroxidase (HRP) or alkaline phosphatase (AP). In one embodiment, the kit includes a blocking reagent that includes at least about 1% and up to about 5%, or between about 2% and 3%, or about 2% cold water fish skin gelatin protein (CWF) in a buffer, such as phosphate buffered saline (PBS). In one embodiment, the kit includes buffer for antigen retrieval, such as a citrate buffer, for example sodium citrate, at a concentration of at least about 1, 2, 5, or 10 mM and up to about 10, 15 or 20 mM and at a pH between about 5.5 and 9, or a pH of about 6.

In another embodiment, a kit for treating diseases involving the expression of PD-L1 is provided, wherein the kit includes an antibody or antigen binding fragment described herein and instructions to administer the antibody or antigen binding fragment to a subject in need of treatment. There is also provided a pharmaceutical or diagnostic pack or kit comprising one or more containers filled with one or more of the ingredients of the pharmaceutical compositions as disclosed herein, such as one or more anti-PD-L1 antibodies or fragments provided herein. Optionally associated with such container(s) can be a notice in the form prescribed by a governmental agency regulating the manufacture, use or sale of pharmaceuticals or biological products, which notice reflects approval by the agency of manufacture, use or sale for human administration, e.g., an authorisation number.

In another embodiment, an article of manufacture that includes a container in which a composition containing an antibody or antigen binding fragment described herein and a package insert or label indicating that the composition can be used to treat diseases characterized by the expression or overexpression of PD-L1 is provided. In one embodiment, there is provided a kit for treating and/or preventing a PD-L1-mediated condition or disease, the kit comprising an antibody or fragment as disclosed herein in any embodiment or combination of embodiments (and optionally a further therapeutic agent as described elsewhere herein) optionally in combination with a label or instructions for use to treat and/or prevent said disease or condition in a human; optionally wherein the label or instructions comprise a marketing authorisation number (e.g., an FDA or EMA authorisation number); optionally wherein the kit comprises an IV or injection device that comprises the antibody or fragment. In another embodiment, the kit comprises an antibody or antigen binding fragment thereof contained within a container or an IV bag. In another embodiment, the container or IV bag is a sterile container or a sterile IV bag. In another embodiment, the antibody or antigen binding fragment therefore is formulated into a pharmaceutical composition contained within a (sterile) container or contained within a (sterile) IV bag. In a further embodiment, the kit further comprises instructions for use.

9. Anti-TIGIT Antibodies, Fragments & Immunocytokines

TIGIT, also named VSIG9, VSTM3 and WUCAM, is a 39.6 KDa (monomer) surface protein composed of an Immunoglobulin Variable (IgV) domain, a transmembrane domain and an Immunoreceptor Tyrosine-based Inhibitory Motif (ITIM) in its cytoplasmic domain. TIGIT is expressed on T cells, both memory and $T_{regs}$ subsets, as well as on NK cells [1]. TIGIT expression was confirmed by quantitative RT-PCR analysis in resting CD4$^+$CD25$^{hi}$ $T_{regs}$ cells and memory CD45RO$^+$ cells. Expression of this protein was found to be upregulated in naïve CD45RA$^+$ CD4$^+$ T cells following activation. TIGIT expression has also been shown to increase in activated Tregs and memory cells. In another publication [2], high levels of TIGIT were found to be associated with exhausted CD8$^+$ T cells.

CD155 (PVR) was identified as TIGIT's high affinity receptor highly expressed on dendritic cells (DCs), fibroblasts and endothelial cells. CD112 (PVRL2) and CD113 (PVRL3), also members of the PVR-like proteins, interact, albeit with lower affinities, with TIGIT. While TIGIT/CD155 cell binding Kd is 1-3 nM, the reported Kd value for interaction between TIGIT/PVRL3 is 38.9 nM. TIGIT shares its binding partners with other Ig-superfamily family members DNAM-1 (CD226) and CD96 (TACTILE). Therefore, affinities reported for members of this family have biological relevance as it might help to understand the dynamic between TIGIT and CD96, both inhibitory receptors unlike DNAM-1 which has been shown to provide activating signals able to modulate activity of T cells and NK cells. The reported high affinity with which CD155 binds to TIGIT (1-3 nM) compared to CD96 (37.6 nM) or DNAM-1 (119 nM) suggests that TIGIT/CD115 may be the dominant interaction, which has implications for the use of an anti-TIGIT antibody for the treatment of cancer. Blocking of this interaction may therefore re-direct binding of CD155 to DNAM-1 and shift balance from suppression to activation of cells that regulate the immune system in the tumour microenviroment.

1. Yu X, Harden K, Gonzalez L C, Francesco M, Chiang E, Irving B, Tom I, Ivelja S, Refino C J, Clark H, Eaton D, Grogan J L. *The surface protein TIGIT suppresses T cell activation by promoting the generation of mature immunoregulatory dendritic cells*. Nat Immunol. 2009 January; 10(1):48-57.
2. Johnston R J, Comps-Agrar L, Hackney J, Yu X1, Huseni M, Yang Y, Park S, Javinal V, Chiu H, Irving B, Eaton D L, Grogan J L. *The Immunoreceptor TIGIT Regulates Antitumor and Antiviral CD8(+) T Cell Effector Function*. Cancer Cell. 2014 Dec. 8; 26(6):923-37.

Generally, where the disclosure of features are provided in the context of anti-PD-L1 and/or ICOS antibodies of the invention, these features may alternatively be applied to the anti-TIGIT aspects of the invention herein (eg, anti-TIGIT antibodies, fragments, ICKs, methods and uses). For example, the compositions, formulations and routes of administration disclosed in the context of anti-PD-L1 and ICOS antibodies of the invention, may be applied mutatis mutandis to the anti-TIGIT aspects of the invention herein. For example, any composition, method or use disclosed in the context of anti-PD-L1 and/or ICOS antibodies of the invention can additionally comprise (or comprise the use of) any anti-TIGIT antibody, fragment or ICK disclosed herein. In one embodiment disclosed therein, the PD-L1 antibodies as disclosed herein may be formatted in a bispecific antibody which has specificity for both PD-L1 (e.g. human PD-L1) and for TIGIT (e.g. an antagonist to TIGIT, such as human TIGIT). In one embodiment disclosed therein, the ICOS antibodies as disclosed herein may be formatted in a bispecific antibody which has specificity for both ICOS (e.g. human ICOS) and for TIGIT (e.g. an antagonist to TIGIT, such as human TIGIT).

Generally, where the disclosure of features is said to be useful mutatis mutandis to the anti-TIGIT aspects of the invention, this means that the disclosure can be read as applying to the anti-TIGIT aspects (such as antibodies, fragments, ICKs, methods or uses) but with the binding specificity relating to TIGIT instead of PD-L1 or another target antigen discussed in that disclosure.

Any method of treating or preventing or any use in the manufacture disclosed herein for anti-PD-L1 antibodies, fragments, immunocytokines and fusion proteins apply mutatis mutandis to the anti-TIGIT antibodies, fragments, immunocytokines of the invention. Any cancer discussed in the context of treating or preventing using an anti-PD-L1 antibody is applicable to treatment or prevention using an anti-TIGIT antibody, fragment, immunocytokine or fusion protein described herein.

In one embodiment, the anti-TIGIT antibody is a polyclonal antibody. Methods for generating polyclonal antibodies are known, and include, for example, inoculating a suitable mammal with an antigen to induce the immune system of the animal to produce immunoglobulins (IgGs) that specifically bind the injected antigen. Examples of suitable mammals include, for example, mouse, guinea pig, hamster, rat, rabbit sheep or goat. The polyclonal IgG is then typically purified from the mammal's serum. In one embodiment, the antibody is a polyclonal antibody that binds to a surface expressed protein. In another embodiment, the antibody is a polyclonal antibody that specifically binds to a TIGIT, such as a human TIGIT. In another embodiment, the antibody is a polyclonal antibody that specifically binds surface expressed TIGIT. In a more particular embodiment, the polyclonal antibody or antigen binding fragment thereof specifically binds human TIGIT. In another embodiment, the antibody is a polyclonal antibody that specifically binds soluble TIGIT. The term "soluble" also refers to a protein, such as TIGIT that is lacking one or more transmembrane domain or cytoplasmic domains. In one embodiment, the "soluble" form of TIGIT lacks both the transmembrane domain and the cytoplasmic domain. In one embodiment, the antibody is a polyclonal antibody that binds "free" TIGIT (i.e. TIGIT that is not associated with a cell membrane or surface, either directly or indirectly).

In another embodiment, the anti-TIGIT antibody can be a monoclonal antibody. Methods of making monoclonal antibodies are known and include, for example, fusing myeloma cells with the cells from an animal that was immunized with the desired antigen. In other embodiments, the monoclonal antibodies may be generated using recombinant DNA technology. In one embodiment, the antibody is a monoclonal antibody that specifically binds a surface expressed protein. In one embodiment, the antibody is a fully human monoclonal antibody. In another embodiment, the antibody is a monoclonal antibody that specifically binds to one or more TIGIT proteins. In a more specific embodiment, the antibody is a monoclonal antibody that specifically binds TIGIT. In another embodiment, the antibody is a monoclonal antibody that specifically binds surface expressed TIGIT. In a more particular embodiment, the monoclonal antibody or antigen binding fragment thereof specifically binds human TIGIT, eg, isoform 2. In another embodiment, the antibody is a monoclonal antibody that specifically binds soluble TIGIT. In one embodiment, the antibody is a monoclonal antibody that specifically binds soluble TIGIT that is lacking one or more transmembrane domain or cytoplasmic domains. In one embodiment, the antibody is a monoclonal antibody that specifically binds soluble TIGIT that is lacking both the transmembrane domain and the cytoplasmic domain. In one embodiment, the antibody is a monoclonal antibody that binds "free" TIGIT" (i.e. TIGIT that is not associated with a cell membrane or surface, either directly or indirectly).

In an example the binding site(s) of the anti-TIGIT antibody or fragment are selected from a plurality (e.g. library) of binding sites. For example, the plurality of binding sites comprises or consists of a plurality of 4-chain antibodies or fragments thereof, e.g. dAbs, Fabs or scFvs. Suitable methods for producing pluralities of binding sites for screening include phage display (producing a phage display library of antibody binding sites), ribosome display (producing a ribosome display library of antibody binding sites), yeast display (producing a yeast display library of antibody binding sites), or immunisation of a non-human vertebrate (e.g. a rodent, e.g. a mouse or rat, e.g. a Velocimouse™, Kymouse™, Xenomouse™, Aliva Mouse™, HuMab Mouse™, Omnimouse™, Omnirat™ or MeMo Mouse™) with hTIGIT or a hTIGIT epitope and isolation of a repertoire of antibody-producing cells (e.g. a B-cell, plasma cell or plasmablast repertoire) and/or a repertoire of isolated antibodies, fragments or binding sites.

TIGIT binding ability, specificity and affinity (Kd, $K_{off}$ and/or $K_{on}$) can be determined by any routine method in the art, e.g. by surface plasmon resonance (SPR). The term "Kd" or "$K_D$", as used herein, is intended to refer to the equilibrium dissociation constant of a particular antibody-antigen interaction. Such binding measurements can be made using a variety of binding assays known in the art, e.g. using surface plasmon resonance (SPR), such as by Biacore™ or using the ProteOn XPR36™ (Bio-Rad®), using KinExA® (Sapidyne Instruments, Inc), or using ForteBio Octet (Pall ForteBio Corp.).

In one embodiment, the surface plasmon resonance (SPR) is carried out under any of the conditions described above wrt anti-PD-L1 antibodies.

The present inventors have identified a number of antibodies having specificity for hTIGIT, which have a number of potential utilities and benefits over existing antibodies. For example, the antibodies described herein may have one or more of the following properties:

a. Specificity for blocking only one of the ligands of TIGIT (e.g. blocks CD155/TIGIT interaction, but not DNAM-1/TIGIT interaction)
b. Immunogenicity/lack of side effects
c. Solubility
d. Stability
e. Ease of formulation
f. Frequency of dosing and/or route of administration, for example due to improved half-life over existing anti-TIGIT antibodies
g. Manufacturability (e.g. expression, ease of purification, isoforms)

KY01 is an anti-TIGIT antibody that comprises a heavy chain variable domain (VH) amino acid sequence of SEQ ID No:603, comprising the CDRH1 amino acid sequence of SEQ ID No:597 (IMGT) or SEQ ID No:600 (Kabat), the CDRH2 amino acid sequence of SEQ ID No:598 (IMGT) or SEQ ID No:601 (Kabat), and the CDRH3 amino acid sequence of SEQ ID No:599 (IMGT) or SEQ ID No:602 (Kabat). The nucleic acid sequence encoding the VH domain is SEQ ID No:604. KY01 has a light chain variable domain (VL) amino acid sequence of SEQ ID No:613, comprising the CDRL1 amino acid sequence of SEQ ID No:607 (IMGT) or SEQ ID No:610 (Kabat), the CDRL2 amino acid sequence of SEQ ID No:608 (IMGT) or SEQ ID No:611 (Kabat), and the CDRL3 amino acid sequence of SEQ ID No:609 (IMGT) or SEQ ID No:612 (Kabat). The nucleic acid sequence encoding the VL domain is SEQ ID No:614. Optionally, the VH domain is comprised by a heavy chain, wherein the heavy chain comprises any of the heavy chain constant region sequences described herein, e.g. SEQ ID No:193, SEQ ID No:195, SEQ ID No:197, SEQ ID No:199, SEQ ID No:203, SEQ ID No:205, SEQ ID No:340, SEQ ID No:524, SEQ ID No:526, SEQ ID No:528, SEQ ID No:530, SEQ ID No:532 or SEQ ID No:534. Optionally, the VL domain is comprised by a light chain, wherein the light chain comprises any of the light chain constant region sequences described herein, e.g. SEQ ID Nos:207, 209, 211, 213, 215, 217, 219, 223, 225, 227, 229, 231, 233, 235, 237, 536 and 538. A full length heavy chain amino acid sequence is SEQ ID No:605 (heavy chain nucleic acid sequence SEQ ID No:606). A full length light chain amino acid sequence is SEQ ID No:615 (light chain nucleic acid sequence SEQ ID No:616).

KY02 is an anti-TIGIT antibody that comprises a heavy chain variable domain (VH) amino acid sequence of SEQ ID No:623, comprising the CDRH1 amino acid sequence of SEQ ID No:617 (IMGT) or SEQ ID No:620 (Kabat), the CDRH2 amino acid sequence of SEQ ID No:618 (IMGT) or SEQ ID No:621 (Kabat), and the CDRH3 amino acid sequence of SEQ ID No:619 (IMGT) or SEQ ID No:622 (Kabat). The nucleic acid sequence encoding the VH domain is SEQ ID No:624. KY02 has a light chain variable domain (VL) amino acid sequence of SEQ ID No:633, comprising the CDRL1 amino acid sequence of SEQ ID No:627 (IMGT) or SEQ ID No:630 (Kabat), the CDRL2 amino acid sequence of SEQ ID No:628 (IMGT) or SEQ ID No:631 (Kabat), and the CDRL3 amino acid sequence of SEQ ID No:629 (IMGT) or SEQ ID No:632 (Kabat). The nucleic acid sequence encoding the VL domain is SEQ ID No:634. Optionally, the VH domain is comprised by a heavy chain, wherein the heavy chain comprises any of the heavy chain constant region sequences described herein, e.g. SEQ ID No:193, SEQ ID No:195, SEQ ID No:197, SEQ ID No:199, SEQ ID No:203, SEQ ID No:205, SEQ ID No:340, SEQ ID No:524, SEQ ID No:526, SEQ ID No:528, SEQ ID No:530, SEQ ID No:532 or SEQ ID No:534. Optionally, the VL domain is comprised by a light chain, wherein the light chain comprises any of the light chain constant region sequences described herein, e.g. SEQ ID Nos:207, 209, 211, 213, 215, 217, 219, 223, 225, 227, 229, 231, 233, 235, 237, 536 and 538. A full length heavy chain amino acid sequence is SEQ ID No:625 (heavy chain nucleic acid sequence SEQ ID No:626). A full length light chain amino acid sequence is SEQ ID No:635 (light chain nucleic acid sequence SEQ ID No:636).

KY03 is an anti-TIGIT antibody that comprises a heavy chain variable domain (VH) amino acid sequence of SEQ ID No:643, comprising the CDRH1 amino acid sequence of SEQ ID No:637 (IMGT) or SEQ ID No:640 (Kabat), the CDRH2 amino acid sequence of SEQ ID No:638 (IMGT) or SEQ ID No:641 (Kabat), and the CDRH3 amino acid sequence of SEQ ID No:639 (IMGT) or SEQ ID No:642 (Kabat). The nucleic acid sequence encoding the VH domain is SEQ ID No:644. KY03 has a light chain variable domain (VL) amino acid sequence of SEQ ID No:653, comprising the CDRL1 amino acid sequence of SEQ ID No:647 (IMGT) or SEQ ID No:650 (Kabat), the CDRL2 amino acid sequence of SEQ ID No:648 (IMGT) or SEQ ID No:651 (Kabat), and the CDRL3 amino acid sequence of SEQ ID No:649 (IMGT) or SEQ ID No:652 (Kabat). The nucleic acid sequence encoding the VL domain is SEQ ID No:654. Optionally, the VH domain is comprised by a heavy chain, wherein the heavy chain comprises any of the heavy chain constant region sequences described herein, e.g. SEQ ID No:193, SEQ ID No:195, SEQ ID No:197, SEQ ID No:199, SEQ ID No:203, SEQ ID No:205, SEQ ID No:340, SEQ ID No:524, SEQ ID No:526, SEQ ID No:528, SEQ ID No:530, SEQ ID No:532 or SEQ ID No:534. Optionally, the VL domain is comprised by a light chain, wherein the light chain comprises any of the light chain constant region sequences described herein, e.g. SEQ ID Nos:207, 209, 211, 213, 215, 217, 219, 223, 225, 227, 229, 231, 233, 235, 237, 536 and 538. A full length heavy chain amino acid sequence is SEQ ID No:645 (heavy chain nucleic acid sequence SEQ ID No:646). A full length light chain amino acid sequence is SEQ ID No:655 (light chain nucleic acid sequence SEQ ID No:656).

KY04 is an anti-TIGIT antibody that comprises a heavy chain variable domain (VH) amino acid sequence of SEQ ID No:663, comprising the CDRH1 amino acid sequence of SEQ ID No:657 (IMGT) or SEQ ID No:660 (Kabat), the CDRH2 amino acid sequence of SEQ ID No:658 (IMGT) or SEQ ID No:661 (Kabat), and the CDRH3 amino acid sequence of SEQ ID No:659 (IMGT) or SEQ ID No:662 (Kabat). The nucleic acid sequence encoding the VH domain is SEQ ID No:664. KY04 has a light chain variable domain (VL) amino acid sequence of SEQ ID No:673, comprising the CDRL1 amino acid sequence of SEQ ID No:667 (IMGT) or SEQ ID No:670 (Kabat), the CDRL2 amino acid sequence of SEQ ID No:668 (IMGT) or SEQ ID No:671 (Kabat), and the CDRL3 amino acid sequence of SEQ ID No:669 (IMGT) or SEQ ID No:672 (Kabat). The nucleic acid sequence encoding the VL domain is SEQ ID No:674. Optionally, the VH domain is comprised by a heavy chain, wherein the heavy chain comprises any of the heavy chain constant region sequences described herein, e.g. SEQ ID No:193, SEQ ID No:195, SEQ ID No:197, SEQ ID No:199, SEQ ID No:203, SEQ ID No:205, SEQ ID No:340, SEQ ID No:524, SEQ ID No:526, SEQ ID No:528, SEQ ID No:530, SEQ ID No:532 or SEQ ID No:534. Optionally, the VL domain is comprised by a light chain, wherein the light chain comprises any of the light chain constant region sequences described herein, e.g. SEQ ID Nos:207, 209, 211, 213, 215, 217, 219, 223, 225, 227, 229, 231, 233, 235, 237, 536 and 538. A full length heavy chain amino acid sequence is SEQ ID No:665 (heavy chain nucleic acid sequence SEQ ID No:666). A full length light chain amino acid sequence is SEQ ID No:675 (light chain nucleic acid sequence SEQ ID No:676).

KY05 is an anti-TIGIT antibody that comprises a heavy chain variable domain (VH) amino acid sequence of SEQ ID No:677 and a nucleic acid sequence encoding the VH domain is SEQ ID No:678. KY05 has a light chain variable domain (VL) amino acid sequence of SEQ ID No:679 and a nucleic acid sequence encoding the VL domain is SEQ ID No:680. Optionally, the VH domain is comprised by a heavy chain, wherein the heavy chain comprises any of the heavy chain constant region sequences described herein, e.g. SEQ ID No:193, SEQ ID No:195, SEQ ID No:197, SEQ ID No:199, SEQ ID No:203, SEQ ID No:205, SEQ ID No:340, SEQ ID No:524, SEQ ID No:526, SEQ ID No:528, SEQ ID No:530, SEQ ID No:532 or SEQ ID No:534. Optionally, the VL domain is comprised by a light chain, wherein the light chain comprises any of the light chain constant region sequences described herein, e.g. SEQ ID Nos:207, 209, 211, 213, 215, 217, 219, 223, 225, 227, 229, 231, 233, 235, 237, 536 and 538.

KY06 is an anti-TIGIT antibody that comprises a heavy chain variable domain (VH) amino acid sequence of SEQ ID No:681 and a nucleic acid sequence encoding the VH domain is SEQ ID No:682. KY06 has a light chain variable domain (VL) amino acid sequence of SEQ ID No:683 and a nucleic acid sequence encoding the VL domain is SEQ ID No:684. Optionally, the VH domain is comprised by a heavy chain, wherein the heavy chain comprises any of the heavy chain constant region sequences described herein, e.g. SEQ ID No:193, SEQ ID No:195, SEQ ID No:197, SEQ ID No:199, SEQ ID No:203, SEQ ID No:205, SEQ ID No:340, SEQ ID No:524, SEQ ID No:526, SEQ ID No:528, SEQ ID No:530, SEQ ID No:532 or SEQ ID No:534. Optionally, the VL domain is comprised by a light chain, wherein the light chain comprises any of the light chain constant region sequences described herein, e.g. SEQ ID Nos:207, 209, 211, 213, 215, 217, 219, 223, 225, 227, 229, 231, 233, 235, 237, 536 and 538.

KY07 is an anti-TIGIT antibody that comprises a heavy chain variable domain (VH) amino acid sequence of SEQ ID No:685 and a nucleic acid sequence encoding the VH domain is SEQ ID No:686. KY07 has a light chain variable domain (VL) amino acid sequence of SEQ ID No:687 and a nucleic acid sequence encoding the VL domain is SEQ ID No:688. Optionally, the VH domain is comprised by a heavy chain, wherein the heavy chain comprises any of the heavy chain constant region sequences described herein, e.g. SEQ ID No:193, SEQ ID No:195, SEQ ID No:197, SEQ ID No:199, SEQ ID No:203, SEQ ID No:205, SEQ ID No:340, SEQ ID No:524, SEQ ID No:526, SEQ ID No:528, SEQ ID No:530, SEQ ID No:532 or SEQ ID No:534. Optionally, the VL domain is comprised by a light chain, wherein the light chain comprises any of the light chain constant region sequences described herein, e.g. SEQ ID Nos:207, 209, 211, 213, 215, 217, 219, 223, 225, 227, 229, 231, 233, 235, 237, 536 and 538.

KY08 is an anti-TIGIT antibody that comprises a heavy chain variable domain (VH) amino acid sequence of SEQ ID No:689 and a nucleic acid sequence encoding the VH domain is SEQ ID No:690. KY08 has a light chain variable domain (VL) amino acid sequence of SEQ ID No:691 and a nucleic acid sequence encoding the VL domain is SEQ ID No:692. Optionally, the VH domain is comprised by a heavy chain, wherein the heavy chain comprises any of the heavy chain constant region sequences described herein, e.g. SEQ ID No:193, SEQ ID No:195, SEQ ID No:197, SEQ ID No:199, SEQ ID No:203, SEQ ID No:205, SEQ ID No:340, SEQ ID No:524, SEQ ID No:526, SEQ ID No:528, SEQ ID No:530, SEQ ID No:532 or SEQ ID No:534. Optionally, the VL domain is comprised by a light chain, wherein the light chain comprises any of the light chain constant region sequences described herein, e.g. SEQ ID Nos:207, 209, 211, 213, 215, 217, 219, 223, 225, 227, 229, 231, 233, 235, 237, 536 and 538.

KY09 is an anti-TIGIT antibody that comprises a heavy chain variable domain (VH) amino acid sequence of SEQ ID No:693 and a nucleic acid sequence encoding the VH domain is SEQ ID No:694. KY09 has a light chain variable domain (VL) amino acid sequence of SEQ ID No:695 and a nucleic acid sequence encoding the VL domain is SEQ ID No:696. Optionally, the VH domain is comprised by a heavy chain, wherein the heavy chain comprises any of the heavy chain constant region sequences described herein, e.g. SEQ ID No:193, SEQ ID No:195, SEQ ID No:197, SEQ ID No:199, SEQ ID No:203, SEQ ID No:205, SEQ ID No:340, SEQ ID No:524, SEQ ID No:526, SEQ ID No:528, SEQ ID No:530, SEQ ID No:532 or SEQ ID No:534. Optionally, the VL domain is comprised by a light chain, wherein the light chain comprises any of the light chain constant region sequences described herein, e.g. SEQ ID Nos:207, 209, 211, 213, 215, 217, 219, 223, 225, 227, 229, 231, 233, 235, 237, 536 and 538.

KY10 is an anti-TIGIT antibody that comprises a heavy chain variable domain (VH) amino acid sequence of SEQ ID No:697 and a nucleic acid sequence encoding the VH domain is SEQ ID No:698. KY10 has a light chain variable domain (VL) amino acid sequence of SEQ ID No:699 and a nucleic acid sequence encoding the VL domain is SEQ ID No:700. Optionally, the VH domain is comprised by a heavy chain, wherein the heavy chain comprises any of the heavy chain constant region sequences described herein, e.g. SEQ ID No:193, SEQ ID No:195, SEQ ID No:197, SEQ ID No:199, SEQ ID No:203, SEQ ID No:205, SEQ ID No:340, SEQ ID No:524, SEQ ID No:526, SEQ ID No:528, SEQ ID No:530, SEQ ID No:532 or SEQ ID No:534. Optionally, the VL domain is comprised by a light chain, wherein the light chain comprises any of the light chain constant region sequences described herein, e.g. SEQ ID Nos:207, 209, 211, 213, 215, 217, 219, 223, 225, 227, 229, 231, 233, 235, 237, 536 and 538.

KY11 is an anti-TIGIT antibody that comprises a heavy chain variable domain (VH) amino acid sequence of SEQ ID No:701 and a nucleic acid sequence encoding the VH domain is SEQ ID No:702. KY11 has a light chain variable domain (VL) amino acid sequence of SEQ ID No:703 and a nucleic acid sequence encoding the VL domain is SEQ ID No:704. Optionally, the VH domain is comprised by a heavy chain, wherein the heavy chain comprises any of the heavy chain constant region sequences described herein, e.g. SEQ ID No:193, SEQ ID No:195, SEQ ID No:197, SEQ ID No:199, SEQ ID No:203, SEQ ID No:205, SEQ ID No:340, SEQ ID No:524, SEQ ID No:526, SEQ ID No:528, SEQ ID No:530, SEQ ID No:532 or SEQ ID No:534. Optionally, the VL domain is comprised by a light chain, wherein the light chain comprises any of the light chain constant region sequences described herein, e.g. SEQ ID Nos:207, 209, 211, 213, 215, 217, 219, 223, 225, 227, 229, 231, 233, 235, 237, 536 and 538.

KY12 is an anti-TIGIT antibody that comprises a heavy chain variable domain (VH) amino acid sequence of SEQ ID No:705 and a nucleic acid sequence encoding the VH domain is SEQ ID No:706. KY12 has a light chain variable domain (VL) amino acid sequence of SEQ ID No:707 and a nucleic acid sequence encoding the VL domain is SEQ ID No:708. Optionally, the VH domain is comprised by a heavy chain, wherein the heavy chain comprises any of the heavy chain constant region sequences described herein, e.g. SEQ ID No:193, SEQ ID No:195, SEQ ID No:197, SEQ ID No:199, SEQ ID No:203, SEQ ID No:205, SEQ ID No:340, SEQ ID No:524, SEQ ID No:526, SEQ ID No:528, SEQ ID No:530, SEQ ID No:532 or SEQ ID No:534. Optionally, the VL domain is comprised by a light chain, wherein the light chain comprises any of the light chain constant region sequences described herein, e.g. SEQ ID Nos:207, 209, 211, 213, 215, 217, 219, 223, 225, 227, 229, 231, 233, 235, 237, 536 and 538.

KY13 is an anti-TIGIT antibody that comprises a heavy chain variable domain (VH) amino acid sequence of SEQ ID No:709 and a nucleic acid sequence encoding the VH domain is SEQ ID No:710. KY13 has a light chain variable domain (VL) amino acid sequence of SEQ ID No:711 and a nucleic acid sequence encoding the VL domain is SEQ ID No:712. Optionally, the VH domain is comprised by a heavy chain, wherein the heavy chain comprises any of the heavy chain constant region sequences described herein, e.g. SEQ ID No:193, SEQ ID No:195, SEQ ID No:197, SEQ ID No:199, SEQ ID No:203, SEQ ID No:205, SEQ ID No:340, SEQ ID No:524, SEQ ID No:526, SEQ ID No:528, SEQ ID No:530, SEQ ID No:532 or SEQ ID No:534. Optionally, the VL domain is comprised by a light chain, wherein the light chain comprises any of the light chain constant region sequences described herein, e.g. SEQ ID Nos:207, 209, 211, 213, 215, 217, 219, 223, 225, 227, 229, 231, 233, 235, 237, 536 and 538.

KY14 is an anti-TIGIT antibody that comprises a heavy chain variable domain (VH) amino acid sequence of SEQ ID No:713 and a nucleic acid sequence encoding the VH domain is SEQ ID No:714. KY14 has a light chain variable domain (VL) amino acid sequence of SEQ ID No:715 and a nucleic acid sequence encoding the VL domain is SEQ ID No:716. Optionally, the VH domain is comprised by a heavy chain, wherein the heavy chain comprises any of the heavy chain constant region sequences described herein, e.g. SEQ ID No:193, SEQ ID No:195, SEQ ID No:197, SEQ ID No:199, SEQ ID No:203, SEQ ID No:205, SEQ ID No:340, SEQ ID No:524, SEQ ID No:526, SEQ ID No:528, SEQ ID No:530, SEQ ID No:532 or SEQ ID No:534. Optionally, the VL domain is comprised by a light chain, wherein the light chain comprises any of the light chain constant region sequences described herein, e.g. SEQ ID Nos:207, 209, 211, 213, 215, 217, 219, 223, 225, 227, 229, 231, 233, 235, 237, 536 and 538.

KY15 is an anti-TIGIT antibody that comprises a heavy chain variable domain (VH) amino acid sequence of SEQ ID No:717 and a nucleic acid sequence encoding the VH domain is SEQ ID No:718. KY15 has a light chain variable domain (VL) amino acid sequence of SEQ ID No:719 and a nucleic acid sequence encoding the VL domain is SEQ ID No:720. Optionally, the VH domain is comprised by a heavy chain, wherein the heavy chain comprises any of the heavy chain constant region sequences described herein, e.g. SEQ ID No:193, SEQ ID No:195, SEQ ID No:197, SEQ ID No:199, SEQ ID No:203, SEQ ID No:205, SEQ ID No:340, SEQ ID No:524, SEQ ID No:526, SEQ ID No:528, SEQ ID No:530, SEQ ID No:532 or SEQ ID No:534. Optionally, the VL domain is comprised by a light chain, wherein the light chain comprises any of the light chain constant region sequences described herein, e.g. SEQ ID Nos:207, 209, 211, 213, 215, 217, 219, 223, 225, 227, 229, 231, 233, 235, 237, 536 and 538. In an alternative the antibody comprises the variable domain (VH) amino acid sequence of SEQ ID No:717 except wherein the sequence ends with VTVSS instead of VIVSS.

KY16 is an anti-TIGIT antibody that comprises a heavy chain variable domain (VH) amino acid sequence of SEQ ID No:721 and a nucleic acid sequence encoding the VH domain is SEQ ID No:722. KY16 has a light chain variable domain (VL) amino acid sequence of SEQ ID No:723 and a nucleic acid sequence encoding the VL domain is SEQ ID No:724. Optionally, the VH domain is comprised by a heavy chain, wherein the heavy chain comprises any of the heavy chain constant region sequences described herein, e.g. SEQ ID No:193, SEQ ID No:195, SEQ ID No:197, SEQ ID No:199, SEQ ID No:203, SEQ ID No:205, SEQ ID No:340, SEQ ID No:524, SEQ ID No:526, SEQ ID No:528, SEQ ID No:530, SEQ ID No:532 or SEQ ID No:534. Optionally, the VL domain is comprised by a light chain, wherein the light chain comprises any of the light chain constant region sequences described herein, e.g. SEQ ID Nos:207, 209, 211, 213, 215, 217, 219, 223, 225, 227, 229, 231, 233, 235, 237, 536 and 538.

KY17 is an anti-TIGIT antibody that comprises a heavy chain variable domain (VH) amino acid sequence of SEQ ID No:725 and a nucleic acid sequence encoding the VH domain is SEQ ID No:726. KY17 has a light chain variable domain (VL) amino acid sequence of SEQ ID No:727 and a nucleic acid sequence encoding the VL domain is SEQ ID No:728. Optionally, the VH domain is comprised by a heavy chain, wherein the heavy chain comprises any of the heavy chain constant region sequences described herein, e.g. SEQ ID No:193, SEQ ID No:195, SEQ ID No:197, SEQ ID No:199, SEQ ID No:203, SEQ ID No:205, SEQ ID No:340, SEQ ID No:524, SEQ ID No:526, SEQ ID No:528, SEQ ID No:530, SEQ ID No:532 or SEQ ID No:534. Optionally, the VL domain is comprised by a light chain, wherein the light chain comprises any of the light chain constant region sequences described herein, e.g. SEQ ID Nos:207, 209, 211, 213, 215, 217, 219, 223, 225, 227, 229, 231, 233, 235, 237, 536 and 538.

KY18 is an anti-TIGIT antibody that comprises a heavy chain variable domain (VH) amino acid sequence of SEQ ID No:729 and a nucleic acid sequence encoding the VH domain is SEQ ID No:730. KY18 has a light chain variable domain (VL) amino acid sequence of SEQ ID No:731 and a nucleic acid sequence encoding the VL domain is SEQ ID No:732. Optionally, the VH domain is comprised by a heavy chain, wherein the heavy chain comprises any of the heavy chain constant region sequences described herein, e.g. SEQ ID No:193, SEQ ID No:195, SEQ ID No:197, SEQ ID No:199, SEQ ID No:203, SEQ ID No:205, SEQ ID No:340, SEQ ID No:524, SEQ ID No:526, SEQ ID No:528, SEQ ID No:530, SEQ ID No:532 or SEQ ID No:534. Optionally, the VL domain is comprised by a light chain, wherein the light chain comprises any of the light chain constant region sequences described herein, e.g. SEQ ID Nos:207, 209, 211, 213, 215, 217, 219, 223, 225, 227, 229, 231, 233, 235, 237, 536 and 538.

KY19 is an anti-TIGIT antibody that comprises a heavy chain variable domain (VH) amino acid sequence of SEQ ID No:733 and a nucleic acid sequence encoding the VH domain is SEQ ID No:734. KY19 has a light chain variable domain (VL) amino acid sequence of SEQ ID No:735 and a nucleic acid sequence encoding the VL domain is SEQ ID No:736. Optionally, the VH domain is comprised by a heavy chain, wherein the heavy chain comprises any of the heavy chain constant region sequences described herein, e.g. SEQ ID No:193, SEQ ID No:195, SEQ ID No:197, SEQ ID No:199, SEQ ID No:203, SEQ ID No:205, SEQ ID No:340, SEQ ID No:524, SEQ ID No:526, SEQ ID No:528, SEQ ID No:530, SEQ ID No:532 or SEQ ID No:534. Optionally, the VL domain is comprised by a light chain, wherein the light chain comprises any of the light chain constant region sequences described herein, e.g. SEQ ID Nos:207, 209, 211, 213, 215, 217, 219, 223, 225, 227, 229, 231, 233, 235, 237, 536 and 538.

KY20 is an anti-TIGIT antibody that comprises a heavy chain variable domain (VH) amino acid sequence of SEQ ID No:737 and a nucleic acid sequence encoding the VH domain is SEQ ID No:738. KY20 has a light chain variable domain (VL) amino acid sequence of SEQ ID No:739 and a nucleic acid sequence encoding the VL domain is SEQ ID No:740. Optionally, the VH domain is comprised by a heavy chain, wherein the heavy chain comprises any of the heavy chain constant region sequences described herein, e.g. SEQ ID No:193, SEQ ID No:195, SEQ ID No:197, SEQ ID No:199, SEQ ID No:203, SEQ ID No:205, SEQ ID No:340, SEQ ID No:524, SEQ ID No:526, SEQ ID No:528, SEQ ID No:530, SEQ ID No:532 or SEQ ID No:534. Optionally, the VL domain is comprised by a light chain, wherein the light chain comprises any of the light chain constant region sequences described herein, e.g. SEQ ID Nos:207, 209, 211, 213, 215, 217, 219, 223, 225, 227, 229, 231, 233, 235, 237, 536 and 538.

KY21 is an anti-TIGIT antibody that comprises a heavy chain variable domain (VH) amino acid sequence of SEQ ID No:741 and a nucleic acid sequence encoding the VH domain is SEQ ID No:742. KY21 has a light chain variable domain (VL) amino acid sequence of SEQ ID No:743 and a nucleic acid sequence encoding the VL domain is SEQ ID No:744. Optionally, the VH domain is comprised by a heavy chain, wherein the heavy chain comprises any of the heavy chain constant region sequences described herein, e.g. SEQ ID No:193, SEQ ID No:195, SEQ ID No:197, SEQ ID No:199, SEQ ID No:203, SEQ ID No:205, SEQ ID No:340, SEQ ID No:524, SEQ ID No:526, SEQ ID No:528, SEQ ID No:530, SEQ ID No:532 or SEQ ID No:534. Optionally, the VL domain is comprised by a light chain, wherein the light chain comprises any of the light chain constant region sequences described herein, e.g. SEQ ID Nos:207, 209, 211, 213, 215, 217, 219, 223, 225, 227, 229, 231, 233, 235, 237, 536 and 538.

KY22 is an anti-TIGIT antibody that comprises a heavy chain variable domain (VH) amino acid sequence of SEQ ID No:745 and a nucleic acid sequence encoding the VH domain is SEQ ID No:746. KY22 has a light chain variable domain (VL) amino acid sequence of SEQ ID No:747 and a nucleic acid sequence encoding the VL domain is SEQ ID No:748. Optionally, the VH domain is comprised by a heavy chain, wherein the heavy chain comprises any of the heavy chain constant region sequences described herein, e.g. SEQ ID No:193, SEQ ID No:195, SEQ ID No:197, SEQ ID No:199, SEQ ID No:203, SEQ ID No:205, SEQ ID No:340, SEQ ID No:524, SEQ ID No:526, SEQ ID No:528, SEQ ID No:530, SEQ ID No:532 or SEQ ID No:534. Optionally, the VL domain is comprised by a light chain, wherein the light chain comprises any of the light chain constant region sequences described herein, e.g. SEQ ID Nos:207, 209, 211, 213, 215, 217, 219, 223, 225, 227, 229, 231, 233, 235, 237, 536 and 538.

KY23 is an anti-TIGIT antibody that comprises a heavy chain variable domain (VH) amino acid sequence of SEQ ID No:749 and a nucleic acid sequence encoding the VH domain is SEQ ID No:750. KY23 has a light chain variable domain (VL) amino acid sequence of SEQ ID No:751 and a nucleic acid sequence encoding the VL domain is SEQ ID No:752. Optionally, the VH domain is comprised by a heavy chain, wherein the heavy chain comprises any of the heavy chain constant region sequences described herein, e.g. SEQ ID No:193, SEQ ID No:195, SEQ ID No:197, SEQ ID No:199, SEQ ID No:203, SEQ ID No:205, SEQ ID No:340, SEQ ID No:524, SEQ ID No:526, SEQ ID No:528, SEQ ID No:530, SEQ ID No:532 or SEQ ID No:534. Optionally, the VL domain is comprised by a light chain, wherein the light chain comprises any of the light chain constant region sequences described herein, e.g. SEQ ID Nos:207, 209, 211, 213, 215, 217, 219, 223, 225, 227, 229, 231, 233, 235, 237, 536 and 538.

The anti-TIGIT antibodies of the invention are described with respect to the following Statements. Unless otherwise stated, all Statements are to be read as being able to be combined with any other concept, aspect, sentence, arrangement or embodiment herein, unless such combination would not make technical sense or is explicitly stated otherwise.

Statements

1. An antibody or fragment which specifically binds to TIGIT (T cell immunoreceptor with Ig and ITIM domains) and comprises a $V_H$ domain which comprises a CDRH3 sequence selected from
   (c) SEQ ID NO: 599, 602, 619, 622, 639, 642, 659, 662 or said selected CDRH3 sequence comprising 3, 2 or 1 amino acid substitution(s); or
   (d) the CDRH3 sequence of an antibody selected from the group consisting of KY01-KY23, or wherein the CDRH3 sequence of said $V_H$ domain comprises 3, 2 or 1 amino acid substitution(s) compared to the CDRH3 sequence of an antibody selected from the group consisting of KY01-KY23.

In an alternative, said group consists of KY01-KY04.

CDR sequences of anti-TIGIT antibodies and fragments may be according to Kabat or IMGT determination. In one embodiment, a CDR herein (eg, the CDRH3) is from 14 to 17, 18, 19, 20, 21 or 22 amino acids.

Optionally, the antibody or fragment of the invention neutralises TIGIT, eg, the antibody or fragment competes with 10A7 for binding to TIGIT and/or for inhibiting the binding of TIGIT to CD155.

2. The antibody or fragment according to Statement 1, wherein
   (i) the $V_H$ domain of the antibody or fragment comprises the CDRH3 sequence of SEQ ID NO:599 or SEQ ID NO:602 and respectively the CDRH1 sequence of SEQ ID NO:597 or SEQ ID NO:600, or the CDRH1 sequence of SEQ ID NO:597 or SEQ ID NO:600 comprising 3, 2 or 1 amino acid substitution(s);
   (ii) the $V_H$ domain of the antibody or fragment comprises the CDRH3 sequence of SEQ ID NO:619 or SEQ ID NO:622 and respectively the CDRH1 sequence of SEQ ID NO:617 or SEQ ID NO:620, or the CDRH1 sequence of SEQ ID NO: 617 or SEQ ID NO:620 comprising 3, 2 or 1 amino acid substitution(s);
   (iii) the $V_H$ domain of the antibody or fragment comprises the CDRH3 sequence of SEQ ID NO:639 or SEQ ID NO:642 and respectively the CDRH1 sequence of SEQ ID NO:637 or SEQ ID NO:640, or the CDRH1 sequence of SEQ ID NO:637 or SEQ ID NO:640 comprising 3, 2 or 1 amino acid substitution(s);
   (iv) the $V_H$ domain of the antibody or fragment comprises the CDRH3 sequence of SEQ ID NO:659 or SEQ ID NO:662 and respectively the CDRH1 sequence of SEQ ID NO:657 or SEQ ID NO:660, or the CDRH1 sequence of SEQ ID NO:657 or SEQ ID NO:660 comprising 3, 2 or 1 amino acid substitution(s).

In an example, the $V_H$ domain of the antibody or fragment comprises the CDRH3 and CDHR1 sequence of an antibody selected from the group consisting of KY01-KY23; or wherein the CDRH3 sequence of said $V_H$ domain comprises 3, 2 or 1 amino acid substitution(s) compared to the CDRH3 sequence of an antibody selected from the group consisting of KY01-KY23 and/or the CDRH1 sequence of said $V_H$ domain comprises 3, 2 or 1 amino acid substitution(s) compared to the CDRH1 sequence of the selected antibody.

3. The antibody or fragment according to Statement 1 or Statement 2, wherein
   (v) the $V_H$ domain of the antibody or fragment comprises the CDRH3 sequence of SEQ ID NO: 599 or SEQ ID NO:602 and respectively the CDRH2 sequence of SEQ ID NO:598 or SEQ ID NO:601, or the CDRH2 sequence of SEQ ID NO:598 or SEQ ID NO:601 comprising 3, 2 or 1 amino acid substitution(s);
   (vi) the $V_H$ domain of the antibody or fragment comprises the CDRH3 sequence of SEQ ID NO:619 or SEQ ID NO:622 and respectively the CDRH2 sequence of SEQ ID NO:618 or SEQ ID NO:621, or the CDRH2 sequence of SEQ ID NO:618 or SEQ ID NO:621, comprising 3, 2 or 1 amino acid substitution(s);
   (vii) the $V_H$ domain of the antibody or fragment comprises the CDRH3 sequence of SEQ ID NO:639 or SEQ ID NO:642 and respectively the CDRH2 sequence of SEQ ID NO:638 or SEQ ID NO:641, or the CDRH2 sequence of SEQ ID NO:638 or SEQ ID NO:641 comprising 3, 2 or 1 amino acid substitution(s);
   (viii) the $V_H$ domain of the antibody or fragment comprises the CDRH3 sequence of SEQ ID NO:659 or SEQ ID NO:662 and respectively the CDRH2 sequence of SEQ ID NO:658 or SEQ ID NO:661, or the CDRH2 sequence of SEQ ID NO:658 or SEQ ID NO:661 comprising 3, 2 or 1 amino acid substitution(s).

In an example, the $V_H$ domain of the antibody or fragment comprises the CDRH3 and CDHR2 sequences of an antibody selected from the group consisting of KY01-KY23; or wherein the CDRH3 sequence of said $V_H$ domain comprises 3, 2 or 1 amino acid substitution(s) compared to the CDRH3 sequence of an antibody selected from the group consisting of KY01-KY23 and/or the CDRH2 sequence of said $V_H$ domain comprises 3, 2 or 1 amino acid substitution(s) compared to the CDRH2 sequence of the selected antibody.

In an example, the $V_H$ domain of the antibody or fragment comprises the CDRH1, CDHR2 and CDRH3 sequences of an antibody selected from the group consisting of KY01-KY23; or wherein the CDRH1 sequence of said $V_H$ domain comprises 3, 2 or 1 amino acid substitution(s) compared to the CDRH1 sequence of an antibody selected from the group consisting of KY01-KY23 and/or the CDRH2 sequence of said $V_H$ domain comprises 3, 2 or 1 amino acid substitution(s) compared to the CDRH2 sequence of the selected antibody and/or the CDRH3 sequence of said $V_H$ domain comprises 3, 2 or 1 amino acid substitution(s) compared to the CDRH3 sequence of the selected antibody.

In an alternative, said group consists of KY01-KY04.

4. The antibody or fragment according to any Statement 1, wherein
   (ix) the $V_H$ domain of the antibody or fragment of comprises the amino acid sequence of SEQ ID NO:603, or a heavy chain variable domain amino acid sequence that is at least 85% identical to SEQ ID NO:603;
   (x) the $V_H$ domain of the antibody or fragment of comprises the amino acid sequence of SEQ ID NO:623, or a heavy chain variable domain amino acid sequence that is at least 85% identical to SEQ ID NO:623;
   (xi) the $V_H$ domain of the antibody or fragment of comprises the amino acid sequence of SEQ ID NO:643, or a heavy chain variable domain amino acid sequence that is at least 85% identical to SEQ ID NO:643;

(xii) the $V_H$ domain of the antibody or fragment of comprises the amino acid sequence of SEQ ID NO:663, or a heavy chain variable domain amino acid sequence that is at least 85% identical to SEQ ID NO:663.

Optionally, the $V_H$ domain of the antibody or fragment of comprises the amino acid sequence of an antibody selected from the group consisting of KY01-KY23, or a heavy chain variable domain amino acid sequence that is at least 85% identical to the amino acid sequence of an antibody selected from the group consisting of KY01-KY23. In an alternative, said group consists of KY01-KY04.

Optionally, where an amino acid sequence (eg, a $V_H$ or $V_L$ sequence) is disclosed as being at least 85% identical to a specified SEQ ID or domain, alternatively one of the following applies:—

In one embodiment, the amino acid sequence is at least 70% identical to the specified SEQ ID NO (or domain). In one embodiment, the amino acid sequence is at least 75% identical to the specified SEQ ID NO (or domain). In one embodiment, the amino acid sequence is at least 95% identical to the specified SEQ ID NO (or domain). In one embodiment, the amino acid sequence is at least 96% identical to the specified SEQ ID NO (or domain). In one embodiment, the amino acid sequence is at least 97% identical to the specified SEQ ID NO (or domain). In one embodiment, the amino acid sequence is at least 98% identical to the specified SEQ ID NO (or domain). In one embodiment, the amino acid sequence is at least 99% identical to the specified SEQ ID NO (or domain). In one embodiment, the amino acid sequence is at least 99.5% identical to the specified SEQ ID NO (or domain). For example, the amino acid sequence is identical to the specified SEQ ID NO or the amino acid sequence of the domain.

5. The antibody or fragment according to any preceding Statement comprising first and second copies of said VH domain.

Optionally, each VH is paired with a VL and comprised by a VH/VL antigen-binding site of the antibody or fragment. In another example, the antibody is a H2 antibody wherein the VH is comprised by a binding site that specifically binds TIGIT and the binding site is devoid of a VL domain.

6. The antibody or fragment according to any preceding Statement, wherein the antibody or fragment comprises a VL domain, wherein the VL domain comprises
   (I) the CDRL3 sequence of SEQ ID NO:609 or SEQ ID NO:612, or the CDRL3 sequence of SEQ ID NO: 609 or SEQ ID NO:612 comprising 3, 2 or 1 amino acid substitution(s), and optionally comprises a VH domain according to Statement 2(i) and/or 3(v); or according to Statement 4(ix);
   (II) the CDRL3 sequence of SEQ ID NO:629 or SEQ ID NO:632, or the CDRL3 sequence of SEQ ID NO:629 or SEQ ID NO:632 comprising 3, 2 or 1 amino acid substitution(s), and optionally comprises a VH domain according to Statement 2(ii) and/or 3(vi); or according to Statement 4(x);
   (III) the CDRL3 sequence of SEQ ID NO:649 or SEQ ID NO:652, or the CDRL3 sequence of SEQ ID NO:649 or SEQ ID NO:652 comprising 3, 2 or 1 amino acid substitution(s), and optionally comprises a VH domain according to Statement 2(iii) and/or 3(vii); or according to Statement 4(xi);
   (IV) the CDRL3 sequence of SEQ ID NO:669 or SEQ ID NO:672, or the CDRL3 sequence of SEQ ID NO:669 or SEQ ID NO:672 comprising 3, 2 or 1 amino acid substitution(s), and optionally comprises a VH domain according to Statement 2(iv) and/or 3(viii); or according to Statement 4(xii); or
   the CDRL1; CDRL2; CDRL3; CDRL1 and CDRL3; CDRL2 and CDRL3; or CDRL1, CDRL2 and CDRL3 sequences of an antibody selected from the group consisting of KY01-KY23, or wherein the or each CDRL sequence of said $V_L$ domain comprises 3, 2 or 1 amino acid substitution(s) compared to the corresponding CDRL sequence of an antibody selected from the group consisting of KY01-KY23. Optionally additionally the antibody or fragment comprises a VH domain comprising the amino acid sequence of a VH domain of said selected antibody.

In an alternative, said group consists of KY01-KY04.

In an alternative, the LCDR3 is the LCDR3 of an anti-TIGIT antibody or VL domain disclosed herein.

7. The antibody or fragment according to Statement 6, wherein
   (V) the $V_L$ domain of (I) respectively comprises the CDRL1 sequence of SEQ ID NO:607 or SEQ ID NO:610, or the CDRL1 sequence of SEQ ID NO:607 or SEQ ID NO:610 comprising 3, 2 or 1 amino acid substitution(s);
   (VI) the $V_L$ domain of (II) respectively comprises the CDRL1 sequence of SEQ ID NO:627 or SEQ ID NO:630, or the CDRL1 sequence of SEQ ID NO:627 or SEQ ID NO:630 comprising 3, 2 or 1 amino acid substitution(s);
   (VII) the $V_L$ domain of (III) respectively comprises the CDRL1 sequence of SEQ ID NO:647 or SEQ ID NO:650, or the CDRL1 sequence of SEQ ID NO:647 or SEQ ID NO:650 comprising 3, 2 or 1 amino acid substitution(s);
   (VIII) the $V_L$ domain of (IV) respectively comprises the CDRL1 sequence of SEQ ID NO:667 or SEQ ID NO:670, or the CDRL1 sequence of SEQ ID NO:667 or SEQ ID NO:670 comprising 3, 2 or 1 amino acid substitution(s).

8. The antibody or fragment according to Statement 6 or 7, wherein
   (IX) the $V_L$ domain of (I) respectively comprises the CDRL2 sequence of SEQ ID NO:608 or SEQ ID NO:611, or the CDRL2 sequence of SEQ ID NO:608 or SEQ ID NO:611 comprising 3, 2 or 1 amino acid substitution(s);
   (X) the $V_L$ domain of (II) respectively comprises the CDRL2 sequence of SEQ ID NO:628 or SEQ IS NO:631, or the CDRL2 sequence of SEQ ID NO:628 or SEQ IS NO:631 comprising 3, 2 or 1 amino acid substitution(s);
   (XI) the $V_L$ domain of (III) respectively comprises the CDRL2 sequence of SEQ ID NO:648 or SEQ ID NO:651, or the CDRL2 sequence of SEQ ID NO:648 or SEQ ID NO:651 comprising 3, 2 or 1 amino acid substitution(s);
   (XII) the $V_L$ domain of (IV) respectively comprises the CDRL2 sequence of SEQ ID NO:668 or SEQ ID NO:671, or the CDRL2 sequence of SEQ ID NO:668 or SEQ ID NO:671 comprising 3, 2 or 1 amino acid substitution(s).

In an example, the $V_L$ domain of the antibody or fragment comprises the CDRL3 and CDHR1 sequence of an antibody selected from the group consisting of KY01-KY23; or wherein the CDRL3 sequence of said VL domain comprises 3, 2 or 1 amino acid substitution(s) compared to the CDRL3 sequence of an antibody selected from the group consisting of KY01-KY23 and/or the CDRL1 sequence of said VL domain comprises 3, 2 or 1 amino acid substitution(s) compared to the CDRL1 sequence of the selected antibody.

In an example, the $V_L$ domain of the antibody or fragment comprises the CDRL3 and CDHR2 sequence of an antibody selected from the group consisting of KY01-KY23; or wherein the CDRL3 sequence of said VL domain comprises 3, 2 or 1 amino acid substitution(s) compared to the CDRL3 sequence of an antibody selected from the group consisting of KY01-KY23 and/or the CDRL2 sequence of said VL domain comprises 3, 2 or 1 amino acid substitution(s) compared to the CDRL2 sequence of the selected antibody.

In an example, the $V_L$ domain of the antibody or fragment comprises the CDRL1, CDRL2 and CDHR3 sequence of an antibody selected from the group consisting of KY01-KY23; or wherein the CDRL1 sequence of said VL domain comprises 3, 2 or 1 amino acid substitution(s) compared to the CDRL1 sequence of an antibody selected from the group consisting of KY01-KY23 and/or the CDRL2 sequence of said VL domain comprises 3, 2 or 1 amino acid substitution(s) compared to the CDRL2 sequence of the selected antibody and/or the CDRL3 sequence of said VL domain comprises 3, 2 or 1 amino acid substitution(s) compared to the CDRL3 sequence of the selected antibody.

9. The antibody or fragment according to any preceding Statement, wherein the antibody or fragment comprises a VL domain, wherein the VL domain comprises
   (XIII) the amino acid sequence of SEQ ID NO:613, or a light chain variable domain amino acid sequence that is at least 85% identical to SEQ ID NO:613;
   (XIV) the amino acid sequence of SEQ ID NO:633, or a light chain variable domain amino acid sequence that is at least 85% identical to SEQ ID NO:633;
   (XV) the amino acid sequence of SEQ ID NO:653, or a light chain variable domain amino acid sequence that is at least 85% identical to SEQ ID NO:653;
   (XVI) the amino acid sequence of SEQ ID NO:673, or a light chain variable domain amino acid sequence that is at least 85% identical to SEQ ID NO:673; or
   the amino acid sequence of a VL domain of an antibody selected from the group consisting of KY01-KY23, or a light chain variable domain amino acid sequence that is at least 85% identical to the amino acid sequence of a VL domain of an antibody selected from the group consisting of KY01-KY23.

10. The antibody or fragment according to any one of Statements 6 to 9 comprising first and second copies of said VL domain.

In an example the antibody comprises first (and optionally a second) anti-TIGIT binding site, wherein the or each binding site comprises a said VH domain paired with a said VL domain.

In an alternative, there is provided:—

An antibody or fragment which specifically binds to TIGIT and comprises a VL domain as recited in any one of Statements 6 to 9, optionally wherein the antibody or fragment comprises a VH domain, wherein the VH domain is a VH domain of an anti-TIGIT antibody or VH domain disclosed herein or wherein the VH domain comprises a HCDR3 of an anti-TIGIT antibody or VH domain disclosed herein.

In an alternative, the antibody or fragment comprises a VL domain of an anti-TIGIT antibody or VL domain disclosed herein.

In an example, the anti-TIGIT antibody or fragment comprises an anti-TIGIT binding site comprising a VH disclosed herein (or a VH of an anti-TIGIT antibody disclosed herein). In an example, the antibody or fragment comprises an anti-TIGIT binding site comprising a VL disclosed herein (or a VL of an anti-TIGIT antibody disclosed herein).

11. An antibody or fragment (optionally according to any preceding Statement), comprising one or more TIGIT binding sites, wherein each binding site specifically binds to TIGIT and comprises a VH domain and a VL domain, wherein
    (a) The VH domain is according to Statement 4(ix) and the VL domain is according to Statement 9 (XIII);
    (b) The VH domain is according to Statement 4(x) and the VL domain is according to Statement 9 (XIV);
    (c) The VH domain is according to Statement 4(xi) and the VL domain is according to Statement 9 (XV);
    (d) The VH domain is according to Statement 4(xii) and the VL domain is according to Statement 9 (XVI);
    (e) Optionally, wherein the VH domain is comprised by an antibody heavy chain, the heavy chain comprising a constant region, wherein the constant region is a human IgG1 or IgG4 constant region; and the VL domain is comprised by an antibody light chain, the light chain comprising a human kappa or lambda constant region.

In an example, the antibody comprises a heavy chain comprising a constant region and a light chain comprising a constant region (eg, two heavy chains and two light chains, wherein each heavy chain is paired with a respective light chain). In an example, the human heavy constant region is a human gamma-1 and the light chain constant region is a human kappa constant region. In an example, the human heavy constant region is a human gamma-4 and the light chain constant region is a human kappa constant region. In an example, the human heavy constant region is a human gamma-1 and the light chain constant region is a human lambda constant region. In an example, the human heavy constant region is a human gamma-4 and the light chain constant region is a human lambda constant region.

In an example, the antibody, fragment or ICK (see anti-TIGIT immunocytokines disclosed herein) comprises a light chain comprising said anti-TIGIT VL and a kappa or lambda constant region. Kappa light chain constant region amino acid and nucleotide sequences can be found in SEQ ID Nos: 206 to 215. In one embodiment, the light chain may be a lambda light chain. Lambda light chain constant region amino acid and nucleotide sequences can be found in SEQ ID Nos: 216 to 237 and SEQ ID No: 535, SEQ ID No:536 and SEQ ID No:538.

12. The antibody or fragment according to any preceding Statement, wherein the amino acid substitutions are conservative amino acid substitutions, optionally wherein each conservative substitutions is from group (1) to (6):
    1) Alanine (A), Serine (S), Threonine (T);
    2) Aspartic acid (D), Glutamic acid (E);
    3) Asparagine (N), Glutamine (Q);
    4) Arginine (R), Lysine (K);
    5) Isoleucine (I), Leucine (L), Methionine (M), Valine (V); and
    6) Phenylalanine (F), Tyrosine (Y), Tryptophan (W).

Each group contains amino acids that are conservative substitutions for one another.

Amino acid substitutions include alterations in which an amino acid is replaced with a different naturally-occurring amino acid residue. Such substitutions may be classified as "conservative", in which case an amino acid residue contained in a polypeptide is replaced with another naturally occurring amino acid of similar character either in relation to polarity, side chain functionality or size. Such conservative substitutions are well known in the art. Substitutions encompassed by the present invention may also be "non-conservative", in which an amino acid residue which is present in a peptide is substituted with an amino acid having different properties, such as naturally-occurring amino acid from a different group (e.g. substituting a charged or hydrophobic amino; acid with alanine), or alternatively, in which a naturally-occurring amino acid is substituted with a non-conventional amino acid.

In one embodiment, the conservative amino acid substitutions are as described herein. For example, the substitution may be of Y with F, T with S or K, P with A, E with D or Q, N with D or G, R with K, G with N or A, T with S or K, D with N or E, I with L or V, F with Y, S with T or A, R with K, G with N or A, K with R, A with S, K or P. In another embodiment, the conservative amino acid substitutions may be wherein Y is substituted with F, T with A or S, I with L or V, W with Y, M with L, N with D, G with A, T with A or S, D with N, I with L or V, F with Y or L, S with A or T and A with S, G, T or V.

13. An antibody or fragment thereof which specifically binds to an epitope that is identical to an epitope to which the antibody of Statement 11 binds, or to which any antibody selected from the group consisting of KY01-KY23 (eg, KY01-KY04) specifically binds.

In one embodiment, the antibody or fragment thereof specifically binds to an epitope that is identical to an epitope to which a reference anti-TIGIT antibody binds, wherein the reference antibody is any one of the anti-TIGIT antibodies selected from KY01-KY23 (eg, KY01-KY04) or the antibody comprises a TIGIT antigen-binding site that comprises the CDRH1, CDRH2, CDRH3, CDRL1, CDRL2 and CDRL3, or the VH, or the VL or the VH and VL domain(s) from RG-6058 (MTIG-7192A), or CASC-TIGIT, or COM-902, or OMP-313M32, or AB-154, or BMS-986207 (ONO-4686), or 313R12, or 313R19, or 313M32, or 741182 (MAB7898) (R & D Systems), or MBSA43 (Affymetrix eBioscience), or 1G9 ab136311 or ab107664 (Abcam), or from any one of the anti-TIGIT antibodies described in WO2017/053748 & US2017/0088613 (including 1A4, 1D3, 4A3, 10A7, 4.1D3.Q1E, 4.1D3, 1A5, h10A7.K4G3, 4.1D3 and the other antibodies described in Examples 1 and 2), WO2017/037707 (including VSIG9 #1 and 258-csl #4), WO2017/030823 (including 14D7, 26B10 and humanized versions in Example 3), WO2016/191643 & US2016/0376365 (including 313RM, 313Rb2, 313Rb1, 313M32, 313M26, 313M34, 313M33, 313R11, 313R12, 313R13, 313R14, 313R19, 313R20, ATCC PTA-122180 and ATCC PTA-122181), WO2016/106302 & US2016/176963 (including 14B2, 13E6, 6F9, 11G11, 10C9, 16F6, 11C9, 27A9, 10D7, 20G6, 24E8, 24G1, 27F1, 15A6, 4E4, 13D1, 9B11, 10B8, 22G2, 19H2, 8C8, 17G4, 25E7, 26D8 and 16A8), WO2016/028656 (including 14A6, 28H5 or 31C6 and humanized versions from Example 6), WO2006/124667 & US2007/054360 & US2009/156495 & US2010/316646 & US2012/219540 & US2015/0152160 & US2016/185863 (including 318.4.1.1, 318.28.2.1, 318.39.1.1, 318.59.3.1, 318.77.1.10), WO2015/143343 & US2017/107300 (including 4D4), and WO2009/126688 & US2009/0258013 & US2013/0251720 (U.S. Pat. No. 9,499,596) & US2017/0145093 (including 10A7 and 1F4); the sequences and features of the anti-TIGIT antibodies are incorporated herein by reference, or the reference antibody is any one of said antibodies.

In one embodiment, the reference antibody is 10A7 (US2013/0251720 discloses 10A7, the sequences of which are disclosed herein by reference).

The invention also provides:—

An anti-TIGIT antibody or fragment thereof which specifically binds to an epitope that is identical to an epitope to which the antibody KY01 specifically binds.

An anti-TIGIT antibody or fragment thereof which specifically binds to an epitope that is identical to an epitope to which the antibody KY02 specifically binds.

An anti-TIGIT antibody or fragment thereof which specifically binds to an epitope that is identical to an epitope to which the antibody KY03 specifically binds.

An anti-TIGIT antibody or fragment thereof which specifically binds to an epitope that is identical to an epitope to which the antibody KY04 specifically binds.

An anti-TIGIT antibody or fragment which competes for binding to human TIGIT with the antibody KY01.

An anti-TIGIT antibody or fragment which competes for binding to human TIGIT with the antibody KY02.

An anti-TIGIT antibody or fragment which competes for binding to human TIGIT with the antibody KY03.

An anti-TIGIT antibody or fragment which competes for binding to human TIGIT with the antibody KY04.

In one embodiment, there is provided an antibody which specifically binds to an epitope which is substantially similar to an epitope to which any of KY01-04 binds.

14. The antibody or fragment according to Statement 13, wherein the epitope is identified by unrelated amino acid scanning, or by X-ray crystallography.

Contact amino acid residues involved in the interaction of antibody and antigen may be determined by various known methods to those skilled in the art.

In one embodiment, sequential replacement of the amino acids of the antigen sequence (using standard molecular biology techniques to mutate the DNA of the coding sequence of the antigen), in this case TIGIT with Alanine (a.k.a Alanine scan), or another unrelated amino acid, may provide residues whose mutation would reduce or ablate the ability of the antibody to recognise the antigen in question. Binding may be assessed using standard techniques, such as, but not limited to, SPR, HTRF, ELISA (which are described elsewhere herein). Other substitutions could be made to enhance the disruption of binding such as changing the charge on the side chain of antigen sequence amino acids (e.g. Lysine change to glutamic acid), switching polar and non-polar residues (e.g. Serine change to leucine). The alanine scan or other amino substitution method may be carried out either with recombinant soluble antigen, or where the target is a cell membrane target, directly on cells using transient or stable expression of the mutated versions.

In one embodiment, protein crystallography may be used to determine contact residues between antibody and antigen (i.e. to determine the epitope to which the antibody binds), crystallography allows the direct visualisation of contact residues involved in the antibody-antigen interaction. As well as standard X-ray crystallography, cryo-electro microscopy has been used to determine contact residues between antibodies and HIV capsid protein (see Lee, Jeong Hyun, et al. "Antibodies to a conformational epitope on gp41 neutralize HIV-1 by destabilizing the Env spike.", Nature communications, 6, (2015)).

In one embodiment, if the antibody recognises a linear epitope, short peptides based on the antigen sequence can be produced and binding of the antibody to these peptides can be assessed using standard techniques, such as, but not limited to, SPR, HTRF, ELISA (which are described elsewhere herein). Further investigation of the epitope could be provided by performing an Alanine scan on any peptides that show binding. Alternative to linear peptides, conformational scans could be carried out using Pepscan technology (pepscan.com/) using their chemical linkage of peptides onto scaffolds, which has been used to determine discontinuous epitopes on CD20 targeting antibodies (Niederfellner, Gerhard, et al. "Epitope characterization and crystal structure of GA101 provide insights into the molecular basis for type I/II distinction of CD20 antibodies.", Blood, 118.2, (2011), 358-367.).

In one embodiment, limited proteolytic digestion and mass spectrophotometry can be used to identify binding epitopes. The antibody-antigen complex is digested by a protease, such as, but not limited to, trypsin. The digested complex peptides are compared to antibody-alone and antigen-alone digestion mass spectrophotometry to determine if a particular epitope is protected by the complexation. Further work involving amino acid substitution, competition binding, may then be employed to narrow down to individual amino acid residues involved in the interaction (see, for example, Suckau, Detlev, et al "Molecular epitope identification by limited proteolysis of an immobilized antigen-antibody complex and mass spectrometric peptide mapping.", Proceedings of the National Academy of Sciences, 87.24, (1990), 9848-9852).

Thus, in one embodiment, the contact residues of the epitope are identified with an unrelated amino acid scan (e.g. alanine scan). In another embodiment, an unrelated amino acid scan (e.g. alanine scan) is carried out using a technique selected from SPR, HTRF, ELISA, X-ray crystallography, cryo-electro microscopy and a combination of limited proteolytic digestion and mass spectrometry. In one embodiment, the unrelated amino acid scan (e.g. alanine scan) is carried out using HTRF. In one embodiment, the unrelated amino acid scan (e.g. alanine scan) is carried out using ELISA.

When the alanine scan is carried out with either ELISA or HTRF, an amino acid residue is identified as contributing to the epitope if the reduction in signal is at least 25%. In one embodiment, the reduction in signal is at least 30%. In one embodiment, the reduction in signal is at least 35%. In one embodiment, the reduction in signal is at least 40%. In one embodiment, the reduction in signal is at least 45%. In one embodiment, the reduction in signal is at least 50%. In one embodiment, the reduction in signal is at least 55%. In one embodiment, the reduction in signal is at least 60%. In one embodiment, the reduction in signal is at least 70%. In one embodiment, the reduction in signal is at least 75%. In one embodiment, the reduction in signal is at least 80%. In one embodiment, the reduction in signal is at least 85%. In one embodiment, the reduction in signal is at least 90%.

When the alanine scan is carried out with SPR, an amino acid residue is identified as contributing to the epitope if there is at least a 10-fold reduction in affinity. In one embodiment, the reduction in affinity is at least 15-fold. In one embodiment, the reduction in affinity is at least 20-fold. In one embodiment, the reduction in affinity is at least 30-fold. In one embodiment, the reduction in affinity is at least 40-fold. In one embodiment, the reduction in affinity is at least 50-fold. In one embodiment, the reduction in affinity is at least 100-fold.

In one embodiment, the contact residues of the epitope are identified by X-ray crystallography. In one embodiment, the contact residues of the epitope are identified by cryo-electro microscopy. In one embodiment, the contact residues of the epitope are identified by a combination of limited proteolytic digestion and mass spectrometry.

15. The antibody or fragment according to Statement 14, wherein the contact residues of the epitope are defined by a reduction in affinity of at least 10-fold in an unrelated amino acid scan, e.g. an alanine scan as determined by SPR.

In one embodiment, the reduction in affinity is at least 15-fold. In one embodiment, the reduction in affinity is at least 20-fold. In one embodiment, the reduction in affinity is at least 30-fold. In one embodiment, the reduction in affinity is at least 40-fold. In one embodiment, the reduction in affinity is at least 50-fold. In one embodiment, the reduction in affinity is at least 100-fold.

SPR may be carried out as described hereinabove.

16. An antibody or fragment thereof which competes for binding to human TIGIT with the antibody of Statement 11 or another reference antibody as discussed under Statement 13, eg, KY01, 02, 03 or 04.

In an example, the human TIGIT comprises SEQ ID NO: 540 or 544. In an example, the hTIGIT is isoform 2. In an example, the hTIGIT is encoded by a nucleotide sequence that is identical to, or at least 90% identical to, SEQ ID NO: 541, 542 or 543.

In one embodiment, the antibody or fragment competes (e.g. in a dose-dependent manner) with hTIGIT (or a fusion protein thereof) for binding to cell surface-expressed hTIGIT. In one embodiment, the antibody or fragment competes (e.g. in a dose-dependent manner) with hTIGIT (or a fusion protein thereof) for binding to soluble hTIGIT.

Optionally, the competition for binding to hTIGIT is conducted using SPR. SPR may be carried out as described hereinabove.

17. An antibody or a fragment thereof which comprises a binding site comprising a $V_H$ domain and a $V_L$ domain, wherein the binding site specifically binds TIGIT, and wherein
c) the VH domain is encoded by a nucleotide sequence that is derived from the recombination of a human VH gene segment, DH gene segment and JH gene segment, wherein the VH gene segment is selected from IGHV3-11, IGHV3-15, IGHV3-20, IGHV3-9 and IGHV4-4; and
d) the VL domain is encoded by a nucleotide sequence that is derived from the recombination of a human VL gene segment and JL gene segment, wherein the VL gene segment is selected from IGKV1-39, IGKV1D-39, IGKV1-5, IGLV3-1, IGKV2-28 and IGLV3-10; and
e) optionally the antibody or fragment is according to any preceding Statement.

In an alternative, the human $V_H$ gene segment is a IGHV3 or IGHV4 gene segment. In an example, the VH is IGHV3-9 and the VL is IGKV2-28. In an example, the VH is IGHV3-15 and the VL is IGLV3-1. In an example, the VH is IGHV3-11 and the VL is IGKV1-39 or IGKV1D-39. In an example, the VH is IGHV3-11 and the VL is IGKV1-5. In an example, the VH is IGHV3-20 and the VL is IGKV1-39 or IGKV1D-39.

For example, the VH gene segment is selected from IGHV3-11*01, IGHV3-15*01, IGHV3-20*01, IGHV3-9*01 and IGHV4-4*02.

For example, the VL is selected from IGKV1-39*01, IGKV1D-39*01, IGKV1-5*03, IGLV3-1*01, IGKV2-28*01 and IGLV3-10*01.

In an alternative, the human $V_L$ gene segment is a IGKV1, IGKV1D, IGLV3 or IGKV2 gene segment.

18. The antibody or fragment according to Statement 17, wherein the DH gene segment is a human gene segment selected from IGHD3-10, IGHD3-9, IGHD6-13, IGHD6-19, IGHD1-14, IGHD2-21, IGHD4-17 and IGHD4-23.

In an example, the DH gene segment is selected from IGHD3-10*01, IGHD3-9*01, IGHD6-13*01, IGHD6-19*01, IGHD1-14*01, IGHD2-21*02, IGHD4-17*01 and IGHD4-23*01.

19. The antibody or fragment according to Statement 17 or 18, wherein the JH gene segment is a human gene segment selected from IGHJ4, IGHJ5 and IGHJ6.

In an example, the JH gene segment is selected from IGHJ4*02, IGHJ5*02 and IGHJ6*02.

20. The antibody or fragment according to Statement 17, 18 or 19, wherein the VL is a Vκ and the JL gene segment is a human gene segment selected from IGKJ2*04 and IGKJ4*01; or the VL is a Vλ and the JL gene segment is a human gene segment selected from IGL1*01, IGL2*01 and IGL3*02.

In an example, the $V_L$ is a Vκ and the JL gene segment is selected from IGKJ2*04 and IGKJ4*01; or the $V_L$ is a Vλ and the JL gene segment is selected from IGL1*01, IGL2*01 and IGL3*02.

21. The antibody or fragment according to any preceding Statement which specifically binds to a human TIGIT comprising SEQ ID NO: 540 or 544; and/or cynomolgus TIGIT comprising SEQ ID NO: 547 or 549; and/or a mouse TIGIT comprising SEQ ID NO: 556 or 559.

In an example, the antibody, fragment or ICK herein specifically binds to a human TIGIT comprising SEQ ID NO: 540. In an example, the antibody, fragment or ICK herein specifically binds to a human TIGIT comprising SEQ ID NO: 544.

In an example, TIGIT herein is a human, mouse or cynomolgus monkey TIGIT.

In one embodiment, the antibody or fragment binds to cynomolgus TIGIT with an affinity of less than 1 nM (e.g. from 1 nM to 0.01 μM or from 1 nM to 0.1 μM, or from 1 nM to 1 μM). In one embodiment, the antibody or fragment binds to cynomolgus TIGIT with an affinity of less than 10 nM (e.g. from 10 nM to 0.01 μM or from 10 nM to 0.1 μM, or from 10 nM to 1 μM). In one embodiment, the antibody or fragment binds to cynomolgus TIGIT with an affinity of less than 0.1 nM (e.g. from 0.1 nM to 0.01 μM or from 0.1 nM to 0.1 μM, or from 0.1 nM to 1 μM). In one embodiment, the antibody or fragment binds to cynomolgus TIGIT with an affinity of less than 0.01 nM (e.g. from 0.011 nM to 0.01 μM or from 0.01 nM to 0.1 μM).

In one embodiment, the antibody or fragment binds to cynomolgus TIGIT with an affinity of within 2-fold of the affinity to hTIGIT. In one embodiment, the antibody or fragment binds to cynomolgus TIGIT with an affinity of within 4-fold of the affinity to hTIGIT. In one embodiment, the antibody or fragment binds to cynomolgus TIGIT with an affinity of within 5-fold of the affinity to hTIGIT. In one embodiment, the antibody or fragment binds to cynomolgus TIGIT with an affinity of within 6-fold of the affinity to hTIGIT. In one embodiment, the antibody or fragment binds to cynomolgus TIGIT with an affinity of within 8-fold of the affinity to hTIGIT. In one embodiment, the antibody or fragment binds to cynomolgus TIGIT with an affinity of within 10-fold of the affinity to hTIGIT.

"hTIGIT" herein is a human TIGIT, eg, a human TIGIT disclosed herein, eg, comprising SEQ ID NO: 540 or 544.

In one embodiment, the antibody or fragment does not detectably bind to cynomolgus TIGIT. In one embodiment, the antibody or fragment does not detectably bind to murine (eg, mouse and/or rat) TIGIT.

In one embodiment, the antibody or fragment binds to murine (eg, mouse and/or rat) TIGIT with an affinity of less than 1 nM (e.g. from 1 nM to 0.01 μM or from 1 nM to 0.1 μM, or from 1 nM to 1 μM). In one embodiment, the antibody or fragment binds to murine TIGIT with an affinity of less than 10 nM (e.g. from 10 nM to 0.01 μM or from 10 nM to 0.1 μM, or from 10 nM to 1 μM). In one embodiment, the antibody or fragment binds to murine TIGIT with an affinity of less than 0.1 nM (e.g. from 0.1 nM to 0.01 μM or from 0.1 nM to 0.1 μM, or from 0.1 nM to 1 μM). In one embodiment, the antibody or fragment binds to murine TIGIT with an affinity of less than 0.01 nM (e.g. from 0.011 nM to 0.01 μM or from 0.01 nM to 0.1 μM).

22. The antibody or fragment according to any preceding Statement, wherein the antibody or fragment comprises a human constant region, e.g. an IgG4 constant region or an IgG1 constant region.

Optionally, the antibody or fragment comprises a constant region, such as a human constant region, for example an effector-null human constant region, e.g. an IgG4 constant region or an IgG1 constant region, optionally wherein the constant region is IgG4-PE (SEQ ID NO:199), or a disabled IgG1 as defined in SEQ ID NO:205. Optionally, the antibody or fragment comprises a murine (eg, mouse and/or rat) constant region. Optionally, the antibody or fragment comprises any of the heavy chain constant region sequences described herein, e.g. SEQ ID No:193, SEQ ID No:195, SEQ ID No:197, SEQ ID No:199, SEQ ID No:203, SEQ ID No:205, SEQ ID No:340, SEQ ID No:524, SEQ ID No:526, SEQ ID No:528, SEQ ID No:530, SEQ ID No:532 or SEQ ID No:534 and/or any of the light chain constant region sequences described herein, e.g. SEQ ID Nos:207, 209, 211, 213, 215, 217, 219, 223, 225, 227, 229, 231, 233, 235, 237, 536 and 538.

23. The antibody or fragment according to Statement 22, wherein the constant region has CDC and/or ADCC activity.

24. The antibody or fragment according to any preceding Statement (eg, a bispecific antibody), further comprising an antigen-binding site that specifically binds another target antigen (eg, human PD-L1 or human ICOS) or binds TIGIT.; or wherein the antigen-binding site is a binding site of an antibody selected from 1D05, 84G09, 413G05, 416E01, STIM003 and STIM001.

In an example, the another target antigen-binding site is a binding site of 1D05.

In an example, the another target antigen-binding site is a binding site of 84G09.

In an example, the another target antigen-binding site is a binding site of STIM003.

Optionally, the another target antigen is an immune checkpoint inhibitor, eg, any immune checkpoint inhibitor disclosed herein, such as hPD-L1 or hICOS. In an example, the another target binding site is an antibody binding site comprising a VH and a VL; a binding site comprised by a constant domain of the antibody (eg, an Fcab binding site) or a non-immunoglobulin binding site (eg, an fibronectin domain). The another target antigen can be any such antigen described herein for antibodies, fragments etc comprising an anti-PD-L1 binding site and these disclosures are applicable mutatis mutandis to the present anti-TIGIT antibodies, fragments and ICKs. For example, the another target antigen is selected from immune checkpoint inhibitors (such as PD-1, CTLA-4, TIGIT, TIM-3, LAG-3 and VISTA, e.g. TIGIT, TIM-3 and LAG-3), immune modulators (such as BTLA, hHVEM, CSF1R, CCR4, CD39, CD40, CD73, CD96, CXCR2, CXCR4, CD200, GARP, SIRPα, CXCL9, CXCL10, CXCL11 and CD155, e.g. GARP, SIRPα, CXCR4, BTLA, hVEM and CSF1R), immune activators (such as CD137, GITR, OX40, CD40, CXCR3 (e.g. agonistic anti-CXCR3 antibodies), CD27, CD3, ICOS (e.g. agonistic anti-ICOS antibodies), for example. ICOS, CD137, GITR and OX40).

In another embodiment, the antibody binds another target antigen which is PD-1 and the binding to PD-1 is provided by an antigen-binding domain (for example, a $V_H$, a $V_L$ or a paired $V_H$ and $V_L$) having any of the sequences, eg, CDR sequences (for example CDRH3 and/or CDRL3) or variable region sequences as described in Aspect 1A. In another embodiment, the antibody binds another target antigen which is PD-L1 and the binding to PD-L1 is provided by an antigen-binding domain (for example, a $V_H$, a $V_L$ or a paired $V_H$ and $V_L$) having any of the sequences, eg, CDR sequences (for example CDRH3 and/or CDRL3) or variable region sequences or comprised by or according to any of the anti-PD-L1 antibodies as described herein (eg, comprises the anti-PD-L1 binding sites of 1D05, 84G09, 413G05 or 416E01, preferably 1D05).

In an example, the antibody, fragment, ICK or fusion protein comprises an anti-TIGIT binding site comprising VH and VL domains of KY01, KY02, KY03 or KY04; and an anti-PD-L1 binding site comprising VH and VL domains of 1D05, 84G09, 413G05 or 416E01, preferably 1D05. For example, the antibody, fragment, ICK or fusion protein comprises an anti-TIGIT binding site comprising VH and VL domains of KY01; and an anti-PD-L1 binding site comprising VH and VL domains of 1D05. For example, the antibody, fragment, ICK or fusion protein comprises an anti-TIGIT binding site comprising VH and VL domains of KY02; and an anti-PD-L1 binding site comprising VH and VL domains of 1D05. For example, the antibody, fragment, ICK or fusion protein comprises an anti-TIGIT binding site comprising VH and VL domains of KY03; and an anti-PD-L1 binding site comprising VH and VL domains of 1D05. For example, the antibody, fragment, ICK or fusion protein comprises an anti-TIGIT binding site comprising VH and VL domains of KY04; and an anti-PD-L1 binding site comprising VH and VL domains of 1D05. In one embodiment, the PD-L1 antigen-binding site comprises the CDRH1, CDRH2, CDR3, CDRL1, CDRL2 and CDRL3, or the VH, or the VL or the VH and VL region from any one of the anti-PD-L1 antibodies selected from atezolizumab (Roche), avelumab (Merck), BMS-936559/MDX-1105 (BMS), durvalumab/Medi4736 (Medimmune), KN-035, CA-170, FAZ-053 M7824, ABBV-368, LY-3300054, GNS-1480, YW243.55.S70, REGN3504 and any of the PD-L1 antibodies disclosed in WO2017/034916, WO2017/020291, WO2017/020858, WO2017/020801, WO2016/111645, WO2016/197367, WO2016/061142, WO2016/149201, WO2016/000619, WO2016/160792, WO2016/022630, WO2016/007235, WO2015/179654, WO2015/173267, WO2015/181342, WO2015/109124, WO2015/112805, WO2015/061668, WO2014/159562, WO2014/165082, WO2014/100079, WO2014/055897, WO2013/181634, WO2013/173223, WO2013/079174, WO2012/145493, WO2011/066389, WO2010/077634, WO2010/036959, WO2010/089411 or WO2007/005874, which antibodies and sequences are incorporated herein by reference.

In an example, the invention provides a multi-specific (eg, bispecific) antibody or combination of antibodies comprising a first binding site that specifically binds to TIGIT (eg, hTIGIT) and a second binding site that specifically binds to PD-L1 (eg, hPD-L1). Optionally, each binding site is an antibody binding site. Optionally, a bispecific antibody as defined herein is provided. Optionally, a kit or pharmaceutical composition comprising an anti-TIGIT antibody and an anti-PD-L1 antibody is provided. Optionally, the TIGIT binding site is a binding site of any anti-TIGIT antibody disclosed herein, eg, any of KY01-23 or the TIGIT antigen-binding site comprises the CDRH1, CDRH2, CDRH3, CDRL1, CDRL2 and CDRL3, or the VH, or the VL or the VH and VL region from RG-6058 (MTIG-7192A), or CASC-TIGIT, or COM-902, or OMP-313M32, or AB-154, or BMS-986207 (ONO-4686), or 313R12, or 313R19, or 313M32, or 741182 (MAB7898) (R & D Systems), or MBSA43 (Affymetrix eBioscience), or 1G9 ab136311 or ab107664 (Abcam), or from any one of the anti-TIGIT antibodies described in WO2017/053748 & US2017/0088613 (including 1A4, 1D3, 4A3, 10A7, 4.1D3.Q1E, 4.1D3, 1A5, h10A7.K4G3, 4.1D3 and the other antibodies described in Examples 1 and 2), WO2017/037707 (including VSIG9 #1 and 258-csl #4), WO2017/030823 (including 14D7, 26B10 and humanized versions in Example 3), WO2016/191643 & US2016/0376365 (including 313RM, 313Rb2, 313Rb1, 313M32, 313M26, 313M34, 313M33, 313R11, 313R12, 313R13, 313R14, 313R19, 313R20, ATCC PTA-122180 and ATCC PTA-122181), WO2016/106302 & US2016/176963 (including 14B2, 13E6, 6F9, 11G11, 10C9, 16F6, 11C9, 27A9, 10D7, 20G6, 24E8, 24G1, 27F1, 15A6, 4E4, 13D1, 9B11, 10B8, 22G2, 19H2, 8C8, 17G4, 25E7, 26D8 and 16A8), WO2016/028656 (including 14A6, 28H5 or 31C6 and humanized versions from Example 6), WO2006/124667 & US2007/054360 & US2009/156495 & US2010/316646 & US2012/219540 & US2015/0152160 & US2016/185863 (including 318.4.1.1, 318.28.2.1, 318.39.1.1, 318.59.3.1, 318.77.1.10), WO2015/143343 & US2017/107300 (including 4D4), and WO2009/126688 & US2009/0258013 & US2013/0251720 (U.S. Pat. No. 9,499,596) & US2017/0145093 (including 10A7 and 1F4); the sequences and features of the anti-TIGIT antibodies are incorporated herein by reference. In an example, the kit comprises an anti-TIGIT antibody disclosed in the immediately preceding sentence and an anti-PD-L1 antibody disclosed in the immediately preceding paragraph).

In an example, the antibody, fragment, ICK or fusion protein comprises an anti-TIGIT binding site comprising VH and VL domains of KY01, KY02, KY03 or KY04; and an anti-ICIOS binding site comprising VH and VL domains selected from STIM0003, STIM0001, those described in arrangement 5 and arrangement 5a hereinbelow, and any of the anti-ICOS antibodies described in sentences 1 to 102 and sentences 1a to 21a. In an example, the antibody, fragment, ICK or fusion protein comprises an anti-TIGIT binding site comprising VH and VL domains of KY01, KY02, KY03 or KY04; and an anti-ICOS binding site comprising VH and VL domains of STIM0003 or STIM0001. For example, the antibody, fragment, ICK or fusion protein comprises an anti-TIGIT binding site comprising VH and VL domains of KY01; and an anti-ICOS binding site comprising VH and VL domains of STIM0003. For example, the antibody, fragment, ICK or fusion protein comprises an anti-TIGIT binding site comprising VH and VL domains of KY02; and an anti-ICOS binding site comprising VH and VL domains of STIM0003. For example, the antibody, fragment, ICK or fusion protein comprises an anti-TIGIT binding site comprising VH and VL domains of KY03; and an anti-ICOS binding site comprising VH and VL domains of STIM0003. For example, the antibody, fragment, ICK or fusion protein comprises an anti-TIGIT binding site comprising VH and VL domains of KY04; and an anti-ICOS binding site comprising VH and VL domains of STIM0003.

In an example, the another antigen is a human immune checkpoint inhibitor, eg, human PD-L1 or human ICOS; or an immune modulator or activator, such as disclosed herein.

In an example, the further binding site is an agonist binding site for said another antigen. In an example, the further binding site is an antagonist binding site for said another antigen.

In an example, the further binding site is an antibody binding site comprising a VH and a VL; a binding site comprised by a constant domain of the antibody (eg, an Fcab binding site) or a non-immunoglobulin binding site (eg, an fibronectin domain). Optionally, the antigen-binding site is any antigen-binding site disclosed herein.

In an aspect, the invention provides any immunocytokine (ICK) disclosed herein, wherein the ICK comprises an anti-TIGIT binding site, wherein the immunocytokine comprises an antibody binding site that specifically binds TIGIT and optionally comprises a VH domain of the heavy chain, the VH domain being an anti-TIGIT VH as defined herein. In an example the binding site comprise an anti-TIGIT VL as described herein.

In an example, the anti-TIGIT ICK or bispecific antibody is for use in a method of treating or preventing a hTIGIT-mediated disease or condition (eg, any disease or condition disclosed herein) in a human or animal subject. Optionally, the method comprises antagonising hPD-L1 and/or hICOS. Optionally, the method comprises antagonising or agonising hICOS.

Optionally, an anti-TIGIT antibody, fragment or ICK of the invention further comprises an anti-ICOS binding site or is in combination with an anti-ICOS antibody, the binding site may be a binding site of any anti-ICOS antibody described in GB patent application 1620414.1 (filed 1 Dec. 2016), or the antibody in the combination may be such an antibody, the sequences of the anti-ICOS antibodies disclosed therein are incorporated herein by reference. For example, the anti-ICOS antibody is selected from STIM001, STIM002, STIM002-B, STIM003, STIM004, STIM005, STIM006, STIM007, STIM008 or STIM009 or comprise the STIM001, STIM002, STIM002-B, STIM003, STIM004, STIM005, STIM006, STIM007, STIM008 and STIM009.

The invention also provides:—

An anti-TIGIT antibody or fragment of the invention comprising an anti-PD-L1 binding site (or in combination with an anti-PD-L1 antibody or binding site) which specifically binds to a PD-L1 epitope to which an anti-PD-L1 antibody disclosed or incorporated by reference herein specifically binds.

An anti-TIGIT antibody or fragment of the invention comprising an anti-PD-L1 binding site (or in combination with an anti-PD-L1 antibody or binding site) which specifically binds to a PD-L1 epitope to which the antibody 84G09 specifically binds.

An anti-TIGIT antibody or fragment of the invention comprising an anti-PD-L1 binding site (or in combination with an anti-PD-L1 antibody or binding site) which specifically binds to a PD-L1 epitope to which the antibody 411B08 specifically binds.

An anti-TIGIT antibody or fragment of the invention comprising an anti-PD-L1 binding site (or in combination with an anti-PD-L1 antibody or binding site) which specifically binds to a PD-L1 epitope to which the antibody 411C04 specifically binds.

An anti-TIGIT antibody or fragment of the invention comprising an anti-PD-L1 binding site (or in combination with an anti-PD-L1 antibody or binding site) which specifically binds to a PD-L1 epitope to which the antibody 411D07 specifically binds.

An anti-TIGIT antibody or fragment of the invention comprising an anti-PD-L1 binding site (or in combination with an anti-PD-L1 antibody or binding site) which specifically binds to a PD-L1 epitope to which the antibody 385F01 specifically binds.

An anti-TIGIT antibody or fragment of the invention comprising an anti-PD-L1 binding site (or in combination with an anti-PD-L1 antibody or binding site) which specifically binds to a PD-L1 epitope to which the antibody 386H03 specifically binds.

An anti-TIGIT antibody or fragment of the invention comprising an anti-PD-L1 binding site (or in combination with an anti-PD-L1 antibody or binding site) which specifically binds to a PD-L1 epitope to which the antibody 389A03 specifically binds.

An anti-TIGIT antibody or fragment of the invention comprising an anti-PD-L1 binding site (or in combination with an anti-PD-L1 antibody or binding site) which specifically binds to a PD-L1 epitope to which the antibody 413D08 specifically binds.

An anti-TIGIT antibody or fragment of the invention comprising an anti-PD-L1 binding site (or in combination with an anti-PD-L1 antibody or binding site) which specifically binds to a PD-L1 epitope to which the antibody 413G05 specifically binds.

An anti-TIGIT antibody or fragment of the invention comprising an anti-PD-L1 binding site (or in combination with an anti-PD-L1 antibody or binding site) which specifically binds to a PD-L1 epitope to which the antibody 413F09 specifically binds.

An anti-TIGIT antibody or fragment of the invention comprising an anti-PD-L1 binding site (or in combination with an anti-PD-L1 antibody or binding site) which specifically binds to a PD-L1 epitope to which the antibody 414B06 specifically binds.

An anti-TIGIT antibody or fragment of the invention comprising an anti-PD-L1 binding site (or in combination with an anti-PD-L1 antibody or binding site) which specifically binds to a PD-L1 epitope to which the antibody 416E01 specifically binds.

24a. For example, the antibody or fragment is a bispecific antibody or fragment. For example, the antibody or fragment is a dual binding antibody or fragment, or a fusion protein comprising an antibody or fragment thereof as defined in any preceding Statement. A dual binding antibody has the meaning as set out above.

In an example, the antibody, fragment or fusion protein of Statement 24 or 24a comprises a bispecific format selected from DVD-Ig, mAb$^2$, FIT-Ig, mAb-dAb, dock and lock, SEEDbody, scDiabody-Fc, diabody-Fc, tandem scFv-Fc, Fab-scFv-Fc, Fab-scFv, intrabody, BiTE, diabody, DART, TandAb, scDiabody, scDiabody-CH$_3$, Diabody-CH$_3$, minibody, knobs-in-holes, knobs-in-holes with common light chain, knobs-in-holes with common light chain and charge pairs, charge pairs, charge pairs with common light chain, in particular mAb$^2$, knob-in-holes, knob-in-holes with common light chain, knobs-in-holes with common light chain and charge pairs and FIT-Ig, e.g. mAb$^2$ and FIT-Ig.

In one embodiment, the bispecific format is selected from DVD-Ig, mAb$^2$, FIT-Ig, mAb-dAb, dock and lock, Fab-arm exchange, SEEDbody, Triomab, LUZ-Y, Fcab, κλ-body, orthogonal Fab, scDiabody-Fc, diabody-Fc, tandem scFv-Fc, Fab-scFv-Fc, Fab-scFv, intrabody, BiTE, diabody, DART, TandAb, scDiabody, scDiabody-CH$_3$, Diabody-CH$_3$, Triple body, Miniantibody, minibody, TriBi minibody, scFv-CH$_3$ KIH, scFv-CH-CL-scFv, F(ab')$_2$-scFv, scFv-KIH, Fab-scFv-Fc, tetravalent HCab, ImmTAC, knobs-in-holes, knobs-in-holes with common light chain, knobs-in-holes with common light chain and charge pairs, charge pairs, charge pairs with common light chain, DT-IgG, DutaMab, IgG(H)-scFv, scFv-(H)IgG, IgG(L)-scFv, scFv-(L)IgG, IgG (L,H)-Fv, IgG(H)-V, V(H)-IgG, IgG(L)-V, V(L)-IgG, KIH IgG-scFab, 2scFv-IgG, IgG-2scFv, scFv4-Ig and zybody.

In one embodiment, the bispecific format is selected from DVD-Ig, FIT-Ig, mAb-dAb, dock and lock, Fab-arm exchange, SEEDbody, Triomab, LUZ-Y, Fcab, κλ-body, orthogonal Fab, scDiabody-Fc, diabody-Fc, tandem scFv-Fc, Fab-scFv-Fc, Fab-scFv, intrabody, BiTE, diabody, DART, TandAb, scDiabody, scDiabody-CH₃, Diabody-CH₃, Triple body, Miniantibody, minibody, TriBi minibody, scFv-CH₃ KIH, scFv-CH-CL-scFv, F(ab')₂-scFv, scFv-KIH, Fab-scFv-Fc, tetravalent HCab, ImmTAC, knobs-in-holes, knobs-in-holes with common light chain, knobs-in-holes with common light chain and charge pairs, charge pairs, charge pairs with common light chain, DT-IgG, DutaMab, IgG(H)-scFv, scFv-(H)IgG, IgG(L)-scFv, scFv-(L)IgG, IgG (L,H)-Fv, IgG(H)-V, V(H)-IgG, IgG(L)-V, V(L)-IgG, KIH IgG-scFab, 2scFv-IgG, IgG-2scFv, scFv4-Ig and zybody, for example DVD-Ig, FIT-Ig, mAb-dAb, dock and lock, SEEDbody, scDiabody-Fc, diabody-Fc, tandem scFv-Fc, Fab-scFv-Fc, Fab-scFv, intrabody, BiTE, diabody, DART, TandAb, scDiabody, scDiabody-CH₃, Diabody-CH₃, minibody, knobs-in-holes, knobs-in-holes with common light chain, knobs-in-holes with common light chain and charge pairs, charge pairs, charge pairs with common light chain, in particular knob-in-holes, knob-in-holes with common light chain, knobs-in-holes with common light chain and charge pairs and FIT-Ig, e.g. FIT-Ig.

In one embodiment, the bispecific format is selected from DVD-Ig, mAb², mAb-dAb, dock and lock, Fab-arm exchange, SEEDbody, Triomab, LUZ-Y, Fcab, κλ-body, orthogonal Fab, scDiabody-Fc, diabody-Fc, tandem scFv-Fc, Fab-scFv-Fc, Fab-scFv, intrabody, BiTE, diabody, DART, TandAb, scDiabody, scDiabody-CH₃, Diabody-CH₃, Triple body, Miniantibody, minibody, TriBi minibody, scFv-CH₃ KIH, scFv-CH-CL-scFv, F(ab')₂-scFv, scFv-KIH, Fab-scFv-Fc, tetravalent HCab, ImmTAC, knobs-in-holes, knobs-in-holes with common light chain, knobs-in-holes with common light chain and charge pairs, charge pairs, charge pairs with common light chain, DT-IgG, DutaMab, IgG(H)-scFv, scFv-(H)IgG, IgG(L)-scFv, scFv-(L)IgG, IgG (L,H)-Fv, IgG(H)-V, V(H)-IgG, IgG(L)-V, V(L)-IgG, KIH IgG-scFab, 2scFv-IgG, IgG-2scFv, scFv4-Ig and zybody, for example DVD-Ig, mAb², mAb-dAb, dock and lock, SEEDbody, scDiabody-Fc, diabody-Fc, tandem scFv-Fc, Fab-scFv-Fc, Fab-scFv, intrabody, BiTE, diabody, DART, TandAb, scDiabody, scDiabody-CH₃, Diabody-CH₃, minibody, knobs-in-holes, knobs-in-holes with common light chain, knobs-in-holes with common light chain and charge pairs, charge pairs, charge pairs with common light chain, in particular mAb², knob-in-holes, knobs-in-holes with common light chain and charge pairs, and knob-in-holes with common light chain, e.g. mAb².

In one embodiment, the bispecific format is selected from DVD-Ig, mAb-dAb, dock and lock, Fab-arm exchange, SEEDbody, Triomab, LUZ-Y, Fcab, κλ-body, orthogonal Fab, scDiabody-Fc, diabody-Fc, tandem scFv-Fc, Fab-scFv-Fc, Fab-scFv, intrabody, BiTE, diabody, DART, TandAb, scDiabody, scDiabody-CH₃, Diabody-CH₃, Triple body, Miniantibody, minibody, TriBi minibody, scFv-CH₃ KIH, scFv-CH-CL-scFv, F(ab')₂-scFv, scFv-KIH, Fab-scFv-Fc, tetravalent HCab, ImmTAC, knobs-in-holes, knobs-in-holes with common light chain, knobs-in-holes with common light chain and charge pairs, charge pairs, charge pairs with common light chain, DT-IgG, DutaMab, IgG(H)-scFv, scFv-(H)IgG, IgG(L)-scFv, scFv-(L)IgG, IgG(L,H)-Fv, IgG(H)-V, V(H)-IgG, IgG(L)-V, V(L)-IgG, KIH IgG-scFab, 2scFv-IgG, IgG-2scFv, scFv4-Ig and zybody, for example DVD-Ig, mAb-dAb, dock and lock, SEEDbody, scDiabody-Fc, diabody-Fc, tandem scFv-Fc, Fab-scFv-Fc, Fab-scFv, intrabody, BiTE, diabody, DART, TandAb, scDiabody, scDiabody-CH₃, Diabody-CH₃, minibody, knobs-in-holes, knobs-in-holes with common light chain, knobs-in-holes with common light chain and charge pairs, charge pairs, charge pairs with common light chain, in particular knob-in-holes, knobs-in-holes with common light chain and charge pairs, and knob-in-holes with common light chain.

25. An anti-TIGIT immunocytokine comprising an immunoglobulin heavy and an optional light chain, wherein immunocytokine comprises an antibody binding site that specifically binds TIGIT and optionally comprises a $V_H$ domain of the heavy chain, the $V_H$ domain being as defined in any preceding Statement.

In an example, the immunocytokine comprises a H2 antibody (ie, an antibody comprising first and second heavy chains and being devoid of a light chain).

26. The immunocytokine of Statement 25, comprising a cytokine (eg, IL-2, eg, human IL-2 or a functional cytokine fragment thereof) fused to the heavy or light chain.

27. The immunocytokine of Statement 25 or 26, wherein
   (i) The heavy chain comprises in N- to C-terminal direction:
      (i) Said VH domain;
      (ii) A heavy chain constant region;
      (iii) Optionally, a linker, (L); and
      (iv) And said cytokine; or
   (ii) The light chain comprises in N- to C-terminal direction:
      (v) A $V_L$ domain of said binding site (eg, a $V_L$ as defined in any one of Statements 6 to 9);
      (vi) A light chain constant region;
      (vii) Optionally, a linker, (L); and
      (viii) And said cytokine.

In one embodiment, the antigen binding site binds TIGIT simultaneously to the IL-2 cytokine binding the αβγ IL-2R. In one embodiment, the antigen binding site binds TIGIT sequentially to the IL-2 cytokine binding the αβγ IL-2R. In one embodiment, the IL-2 cytokine additionally binds the intermediate (βγ) IL-2R.

In one embodiment, the immunocytokine inhibits TIGIT-mediated suppression of NK and/or T-cells. In one embodiment, the immunocytokine inhibits TIGIT-mediated suppression of NK and/or T-cells in an in vitro assay.

28. The immunocytokine of Statement 25, 26 or 27, further comprising an antigen-binding site that specifically binds another antigen (eg, human PD-L1) or TIGIT; optionally wherein the further binding site is a binding site of an antibody selected from 1D05, 84G09, 413G05, 416E01, STIM003 and STIM001.

In an example, the another antigen-binding site is a binding site of 1D05.

In an example, the another antigen-binding site is a binding site of 84G09.

In an example, the another antigen-binding site is a binding site of STIM003.

The examples of another antigen and other features of Statements 24 and 24a apply mutatis mutandis to Statement 28. Any of the disclosure herein relating to an anti-immune checkpoint inhibitor ICK (eg, an anti-PD-L1 ICK or anti-ICOS ICK) applies mutatis mutandis to anti-TIGIT ICKs herein (eg, ICKs of Statements 25 onwards), except where the ICK specificity is for TIGIT instead of the immune checkpoint inhibitor or in addition to the immune checkpoint inhibitor. Any of the embodiments of aspect 1 herein relating to anti-PD-L1 ICKs apply mutatis mutandis to anti-TIGIT ICKs herein (eg, ICKs of Statements 25 onwards), except where the ICK specificity is for TIGIT instead of PD-L1 or in addition to PD-L1. Any of the features or embodiments of anti-PD-L1 ICK aspects 2 to 54 apply mutatis mutandis anti-TIGIT ICKs herein (eg, ICKs of Statements 25 onwards), except where the ICK specificity is for TIGIT instead of PD-L1 or in addition to PD-L1. Any of the features of the antibodies or other embodiments or features of concepts 1 to 70 apply mutatis mutandis to anti-TIGIT ICKs herein (eg, ICKs of Statements 25 onwards), except where the ICK specificity is for TIGIT instead of PD-L1 or in addition to PD-L1.

29. The antibody, fragment or immunocytokine according to any preceding Statement wherein the antibody or fragment is capable of inhibiting TIGIT-mediated suppression of T-cells and/or NK cells that express TIGIT, for example by increasing activation as measured by an increase in one or more of IFNγ, IL-2, CD25 or proliferation of T-cells and/or NK cells in an assay that provides co-stimulation by direct CD3/CD28 stimulation or provides co-stimulation by co-incubation with cells capable of inducing a T-cell and/or NK cell response.

In an example, the antibody, fragment or immunocytokine is capable of inhibiting TIGIT-mediated suppression of T-cells and/or NK cells that express TIGIT, for decreasing release of of IL-10 and increasing release of IL-12 by dentritic cells expressing one or more TIGIT binding patterns, eg, CD155, CD112 and/or CD113.

The measurements may be carried out with any suitable technique. For example, the measurements may be taken with ELISA, DELFIA® Time-resolved fluorescence, HTRF, BRDU incorporation (proliferation), electrochemiluminescence (ECL) or flow cytometry (e.g. FACS). These techniques are well-known to those skilled in the art and are described elsewhere herein. In one embodiment, the assay is DELFIA® Time-resolved fluorescence. In one embodiment, the assay is flow cytometry. In one embodiment, the assay is ELISA. In one embodiment, the assay is HTRF.

In one embodiment, inhibiting of said TIGIT-meditated immune suppression of T cells is measured by an increase in IFNγ. In one embodiment, inhibiting of said TIGIT-meditated immune suppression of T cells is measured by an increase in IL-2. In one embodiment, inhibiting of said TIGIT-meditated immune suppression of T cells is measured by an increase in CD25. In one embodiment, inhibiting of said TIGIT-meditated immune suppression of T cells is measured by an increase in IFNγ and IL-2. In one embodiment, inhibiting of said TIGIT-meditated immune suppression of T cells is measured by an increase in IFNγ and CD25. In one embodiment, inhibiting of said TIGIT-meditated immune suppression of T cells is measured by an increase in CD25 and IL-2. In one embodiment, inhibiting of said TIGIT-meditated immune suppression of T cells is measured by an increase in IFNγ, IL-2 and CD25.

In one embodiment, the inhibiting of said TIGIT-meditated immune suppression of T cells is measured by an decrease in IL-10 produced by dentric cells. In one embodiment, the inhibiting of said TIGIT-meditated immune suppression of T cells is measured by a increase in IL-12 produced by dentric cells. In one embodiment, inhibiting of said TIGIT-meditated immune suppression of T cells is measured by a decrease of IL-10 and an increase in IL-12 produced by dentric cells.

In one embodiment, the co-stimulation is provided by direct CD3/CD28 stimulation.

In one embodiment, the co-stimulation is provided by a superantigen, such as staphylococcal enterotoxin B (SEB).

In one embodiment, the assay provides co-stimulation by co-incubation with cells capable of inducing a T-cell response. Such cells may be antigen-presenting cells (APCs), for example monocytes, B-cells or dendritic cells. In one embodiment, the assay provides co-stimulation by co-incubation with APCs. In one embodiment, the assay provides co-stimulation by co-incubation with monocytes. In one embodiment, the assay provides co-stimulation by co-incubation with B-cells. In one embodiment, the assay provides co-stimulation by co-incubation with dendritic cells.

The antibody, fragment or immunocytokine according to any preceding Statement wherein the antibody or fragment is capable of inhibiting TIGIT-mediated suppression of NK cells that express TIGIT, for example by increasing activation as measured by an increase of IFNγ and/or increasing NK-mediated cytotoxicity.

In one embodiment, inhibiting of said TIGIT-meditated immune suppression of NK cells is measured by an increase in IFNγ. In one embodiment, inhibiting of said TIGIT-meditated immune suppression of NK cells is measured by an increase in killing of target cells (eg. tumour cells expressing CD155 and/or CD112). In one embodiment, inhibiting of said TIGIT-meditated immune suppression of NK cells is measured by an increase in IFNγ and an increase in killing of target cells (eg. tumour cells expressing CD155 and/or CD112).

In one embodiment, inhibiting of said TIGIT-meditated immune suppression of NK cells is measured by an increase in killing of target cells (eg. tumour cells expressing CD155 and/or CD112) in vitro. In one embodiment, inhibiting of said TIGIT-meditated immune suppression of NK cells is measured by an increase in killing of target cells (eg. tumour cells expressing CD155 and/or CD112) in vivo. In one embodiment, inhibiting of said TIGIT-meditated immune suppression of NK cells is measured by an increase in IFNγ and an increase in killing of target cells (eg. tumour cells expressing CD155 and/or CD112) in vitro. In one embodiment, inhibiting of said TIGIT-meditated immune suppression of NK cells is measured by an increase in IFNγ and an increase in killing of target cells (eg. tumour cells expressing CD155 and/or CD112) in vivo.

In one embodiment, inhibiting of said TIGIT-meditated immune suppression of NK cells is measured by an increase in DNAM-1-mediated activation. In one embodiment, inhibiting of said TIGIT-meditated immune suppression of NK cells is measured by an increase in DNAM-1-mediated activation and an increase in killing of target cells (eg. tumour cells expressing CD155 and/or CD112) in vitro or in vivo.

In an example, the T-cells comprise memory T-cells (eg, memory CD45RO$^+$ cells) and/or CD4$^+$CD25$^{hi}$ Tregs cells, eg, which T-cells express Foxp3 and/or GITR. In an embodiment, the cells express PD-1, eg, comprise CD8$^+$, PD-1$^+$ T-cells and/or CD4$^+$, PD-1$^+$ T-cells. In an example, the T-cells comprise lung, colon, breast, uterine or renal cancer patient CD8$^+$ TILS or T-cells, eg, Lung, colon, uterine, breast or kidney cancer, eg, lung (LUSC), non-small-cell carcinomas (NSCLC), colon adenocarcinoma (COAD), uterine corpus endometroid carcicoma (UCEC), breast (BRCA) or kidney renal cell carcinoma (KIRC) cancer patient CD8$^+$ TILS or T-cells, eg, wherein the cancer is a PD-L1 positive cancer.

30. The antibody, fragment or immunocytokine according to any preceding Statement wherein the antibody, fragment or immunocytokine is capable of inhibiting TIGIT-mediated immune suppression of T-cells and/or NK cells that express TIGIT, wherein the antibody, fragment or immunocytokine is for administration to a subject for increasing T- and/or NK cell proliferation, cytokine production by T- and/or NK cells, or degranulation of tumour antigen-specific CD8+ T cells and/or TIL CD8+ T cells in the subject for treating cancer or viral infection in the subject.

Optionally, the antibody, fragment or immunocytokine is capable of inhibiting TIGIT-meditated immune suppression of T-cells and/or NK cells that express TIGIT in vitro. Optionally, the antibody, fragment or immunocytokine is capable of (or for) of inhibiting TIGIT-meditated immune suppression of T-cells and/or NK cells that express TIGIT in vivo. Optionally, the antibody, fragment or immunocytokine is capable of inhibiting hTIGIT-meditated immune suppression of human T-cells and/or human NK cells that express hTIGIT.

Optionally, the subject is a human or animal subject, eg, wherein the subject is refractory to another cancer therapy.

31. The antibody, fragment or immunocytokine according to any preceding Statement wherein the antibody, fragment or immunocytokine is capable of inhibiting TIGIT-meditated immune suppression of human T-cells and/or human NK cells that express TIGIT, wherein the antibody, fragment or immunocytokine is for administration to a human subject for treating a cancer in the subject by enhancing T- and/or NK cell-mediated anti-cancer immune activity in the subject.

Optionally, the antibody, fragment or immunocytokine is capable of (or for) enhancing anti-cancer immune activity of exhausted $CD8^+T$ cells in a subject, eg, for treating or preventing a disease or condition such as cancer or an autoimmune condition disclosed herein. Optionally, the subject is a human or animal subject, eg, wherein the subject is refractory to another cancer therapy.

32. The antibody, fragment or immunocytokine according to any preceding Statement wherein the antibody, fragment or immunocytokine is capable of inhibiting TIGIT-meditated immune suppression of human Treg cells that express TIGIT, wherein the antibody or fragment is for administration to a human subject for treating a cancer in the subject by reducing Treg-mediated suppression of anti-cancer immune activity in the subject.

In an example, the antibody, fragment or immunocytokine is capable of inhibiting TIGIT-meditated immune suppression of human Treg cells that express TIGIT, wherein the antibody or fragment is for administration to a human subject for treating a cancer in the subject by depleting Treg cells in the subject.

Optionally, the antibody or fragment comprises an IgG1 constant region having ADCC and/or CDC activity, wherein the antibody or fragment is capable of inhibiting TIGIT expressed by human Treg cells, wherein the antibody or fragment is for administration to a human subject for treating a cancer (or other disease or condition mentioned herein) in the subject by ADCC and/or CDC-mediated depletion of Treg cells in the subject.

33. The antibody, fragment or immunocytokine according to any one of Statements 30 to 32 wherein the antibody or fragment is capable of inhibiting binding of TIGIT with one or more of CD155, CD112 and CD113 (eg, CD155) for carrying out said increasing of Statement 30, enhancing of Statement 31, or reducing of Statement 32.

In an embodiment, the CD155 disclosed herein is CD155 (sCD155) that lacks a transmembrane region. sCD155 levels have been found to be significantly higher in the sera of patients with lung, gastrointestinal, breast, and gynecologic cancers. sCD155 levels have been seen to be significantly higher in patients with early stage (stages 1 and 2) gastric cancer than in healthy donors, and were significantly higher in patients with advanced stage (stages 3 and 4) disease than in patients in those with early stage disease and healthy donors. Optionally, therefore, the CD155 is sCD155 and the subject (eg, human) is a lung, gastrointestinal, breast, or gynecologic cancer patient or the cancer treated or prevented by the antibody, fragment or immunocytokine is such a cancer. Additionally or alternatively, the antibody, fragment or ICK of the invention is capable of binding (or binds) cell-surface TIGIT for treating or preventing said disease or condition in a subject comprising serum sCD155. In an embodiment, the subject is suffering from, or the cancer is, a stage 1 or 2 gastric cancer.

In an embodiment, the antibody or fragment or ICK is capable of binding TIGIT in a binding assay selected from
  (a) A ELISA or HTRF assay used to detect binding of human TIGIT by the antibody or fragment or ICK compared a first control anti-TIGIT antibody (deemed to be 100% binding of human TIGIT), [eg, wherein the control antibody is MAB7898 (R&D Systems)] and wherein a second control antibody is deemed to have 0% binding of human TIGIT (eg, wherein the second control antibody is M5534, Sigma Aldrich);
  (b) A ELISA or HTRF assay used to detect binding of cynomolgus monkey TIGIT by the antibody or fragment or ICK compared a third control anti-TIGIT antibody (deemed to be 100% binding of cyno TIGIT), [eg, wherein the control antibody MBSA43 (eBiosciences)] and wherein a fourth control antibody is deemed to have 0% binding of cyno TIGIT (eg, wherein the fourth control antibody is M5284, Sigma Aldrich); and
  (c) An ELISA or HTRF assay to detect binding of the antibody, fragment or ICK to mouse TIGIT by the antibody or fragment or ICK compared a fifth control anti-TIGIT antibody (deemed to be 100% binding of mouse TIGIT), [eg, wherein the control antibody is 142102 (Biolegend)] and wherein a sixth control antibody is deemed to have 0% binding of mouse TIGIT (eg, wherein the sixth control antibody is M5284, Sigma Aldrich).

For example, wherein
  (i) The TIGIT is human TIGIT, the binding of the antibody or fragment or ICK is >5% versus the first control, eg, >10, 20, 30, 40, 50, 60, 70, 80, 90 or 95%;
  (ii) The TIGIT is mouse TIGIT, the binding of the antibody or fragment or ICK is >5% versus the fifth control, eg, >10, 20, 30, 40, 50, 60, 70, 80, 90 or 95%; or
  (iii) The TIGIT is cyno TIGIT, the binding of the antibody or fragment or ICK is >5% versus the third control, eg, >10, 20, 30, 40, 50, 60, 70, 80, 90 or 95%.

In an embodiment, the antibody or fragment or ICK is capable of inhibiting binding of CD155 to TIGIT in an assay selected from a
  (a) HTRF or flow cytometry assay used to detect inhibiting binding of hCD155 to hTIGIT by the antibody or fragment or ICK determined by comparing the HTRF or flow cytometry assay signal thereof to the HTRF signal of binding of CD155 to TIGIT in the absence of the antibody or fragment or ICK (the latter deemed to be 100% binding); and wherein the HTRF or flow cytometry assay signal in the presence of CD155 (but in the absence of TIGIT) or vice versa is deemed to have 0% binding;

(b) HTRF or flow cytometry assay used to detect inhibiting binding of cyno CD155 to cyno TIGIT by the antibody or fragment or ICK determined by comparing the HTRF or flow cytometry assay signal thereof to the HTRF signal of binding of CD155 to TIGIT in the absence of the antibody or fragment or ICK (the latter deemed to be 100% binding); and wherein the HTRF or flow cytometry assay signal in the presence of CD155 (but in the absence of TIGIT) or vice versa is deemed to have 0% binding; and (c) HTRF or flow cytometry assay used to detect inhibiting binding of mouse CD155 to mouse TIGIT by the antibody or fragment or ICK determined by comparing the HTRF or flow cytometry assay signal thereof to the HTRF signal of binding of CD155 to TIGIT in the absence of the antibody or fragment or ICK (the latter deemed to be 100% binding); and wherein the HTRF or flow cytometry assay signal in the presence of CD155 (but in the absence of TIGIT) or vice versa is deemed to have 0% binding.

For example, in the HTRF or flow cytometry assay signal of binding of said CD155 to TIGIT in the presence of the antibody or fragment or ICK is <70%, eg<60, 50, 40, 30, 20, 10, 5, 4, 3, 2 or 1%.

In one embodiment, the concentration of test antagonist (e.g. antibody or fragment or ICK) is titrated to provide a curve of % specific binding. In an example, the % specific binding of the test antagonist is determined, for example using Equation 18 below; and/or the IC50 of the antagonist is determined, for example using Equation 20 below.

In an example, the % specific binding of the antagonist is determined using HTRF by:

1. Combining recombinant hCD155 with recombinant hTIGIT in a plate;

2. Allowing a sufficient period of time to reach binding equilibrium (e.g. 30 min);

3. Adding test antagonist and leaving for a sufficient period of time to equilibrate (e.g. approximately 1 hour);

4. Reading the plate using a reader capable of exciting the donor molecule and capable of measuring the wavelength of emission of both the donor and accepter fluorescent molecules; and 5. Determining the % specific binding of the test antagonist, for example using Equation 18; and/or 6. Determining the IC50 of the antagonist (e.g. antibody or fragment thereof), for example using Equation 20.

Similarly, these steps can be carried out where the assay is a flow cytometry assay except in step 1 the TIGIT is cell-expressed.

Examples of plate readers include EnVision™ (Perkin Elmer), PHERAstar® FSX, CLARIOstar®, and FLUOstar®, and POLARstar® Omega. Suitable FACS apparatus for a flow cytometry assay is Cytoflex™.

In one embodiment, the HTRF assay is carried out in HTRF buffer (e.g. PBS (Sigma)+0.53 M KF (Sigma)+0.1% w/v BSA (Sigma)). In one embodiment, the FACS assay is carried out in FACS buffer (eg, PBS (Sigma)+1% w/v BSA+0.1% w/v sodium azide).

The data (e.g. % specific binding) can be fitted using standard analysis techniques, e.g., using GraphPad/PRISM analysis software.

In an embodiment, the antibody or fragment or ICK inhibits TIGIT binding to CD155 in a TIGIT/CD155 receptor-ligand neutralisation HTRF assay.

In an embodiment, the antibody or fragment or ICK is capable of specifically binding to cell surface TIGIT expressed by CHO cells, wherein the TIGIT is mouse or human TIGIT.

In an embodiment, the antibody or fragment or ICK specifically binds and/or neutralises human and/or mouse TIGIT in an assay, wherein the assay is selected from
(a) A HTRF assay;
(b) A FACS assay; or
(c) An SPR assay.

In an embodiment, the antibody or fragment or ICK
(a) binds to human TIGIT with a KD in the range from 0.1 to 5 nM as determined by SPR;
(b) binds to cynomolgus monkey TIGIT with a KD in the range from 0.1 to 50 nM as determined by SPR; and/or
(c) Neutralises the binding of TIGIT (eg, human TIGIT) to CD155 (eg, human CD155) with an IC50 in the range from 0.09 to 1, 2 or 3 nM as measured by flow cytometry or ligand-receptor HTRF® assay.

In an embodiment, the antibody or fragment or ICK inhibits TIGIT binding to CD155 in a TIGIT/CD155 receptor-ligand neutralisation HTRF assay.

In an embodiment, the antibody or fragment or ICK inhibits TIGIT binding to CD155 in a TIGIT/CD155 receptor-ligand neutralisation HTRF assay.

In an embodiment, the CD155 disclosed herein is expressed on dendritic cells or activated T-cells.

34. The antibody, fragment or immunocytokine according to any preceding Statement wherein the antibody, fragment or immunocytokine is not capable of inhibiting binding of hCD96 and/or hDNAM-1 (CD226) with hCD155 and/or CD112; or wherein the antibody, fragment or immunocytokine inhibits the binding of CD155 and/or CD112 with TIGIT to a greater extent or a stronger affinity (eg, as determined by SPR) than with DNAM-1.

35. The antibody, fragment or immunocytokine according to any preceding Statement wherein the antibody, fragment or immunocytokine is capable of inhibiting binding of hCD96 and/or hDNAM-1 with hCD155.

The invention also provides:—

The antibody or fragment or ICK according to any Statement wherein the antibody or fragment or ICK is capable of inhibiting TIGIT mediated inhibition of DNAM-1 homodimerization. Additionally or alternatively, the antibody or fragment or ICK according to any Statement wherein the antibody or fragment or ICK is capable of inhibiting binding of hCD96 with hCD155 more strongly than hDNAM-1 (CD226) with hCD155.

The antibody or fragment or ICK according to any Statement wherein the antibody or fragment or ICK is capable of inhibiting homodimerization of TIGIT. Additionally or alternatively, the antibody or fragment or ICK is capable of inhibiting homodimerization of CD155. Additionally or alternatively, the antibody or fragment or ICK is capable of inhibiting homodimerization of CD96. In an example, the antibody or fragment or ICK is capable of inhibiting homodimerization by no more than 50, 60, 70, 80, 90 or 95% versus homodimerization in the absence of the antibody or fragment or ICK.

Additionally or alternatively, the antibody or fragment or ICK is not capable of inhibiting homodimerization of CD226. In an alternative to being "not capable of inhibiting", the antibody or fragment or ICK is capable of inhibiting homodimerization of CD226 by no more than 1, 2, 3, 4 5, 6, 7, 8, 9 or 10% versus homodimerization in the absence of the antibody or fragment or ICK.

Optionally, the antibody or fragment or ICK does not inhibit CD226 or CD226-mediated signalling in T and/or NK cells.

Optionally, the antibody or fragment or ICK is capable of inhibiting binding of TIGIT expressed by T-cells with hCD155 expressed by dendritic cells (DCs), eg, for reducing or suppressing IL-10 production in a subject for treating or preventing cancer or another disease or condition disclosed herein; and/or eg, for inhibiting reduction of IL-12 and IFN-γ secretion in a subject for treating or preventing cancer or another disease or condition disclosed herein.

Optionally, the antibody or fragment or ICK is capable of inhibiting binding of TIGIT expressed by NK cells with hCD155 expressed by dendritic cells (DCs), eg, for reducing or suppressing IL-10 production in a subject for treating or preventing cancer or another disease or condition disclosed herein; and/or eg, for inhibiting reduction of IL-12 and IFN-γ secretion in a subject for treating or preventing cancer or another disease or condition disclosed herein.

Optionally, the antibody or fragment or ICK is capable of inhibiting binding of TIGIT expressed by NK cells with hCD155 expressed by T-cells, eg, for reducing or suppressing IL-10 production in a subject for treating or preventing cancer or another disease or condition disclosed herein; and/or eg, for inhibiting reduction of IL-12 and IFN-γ secretion in a subject for treating or preventing cancer or another disease or condition disclosed herein. In an example, the T-cells are CD4+ T-cells. In an example, the T-cells are CD8+ T-cells.

Optionally, the the antibody or fragment or ICK is capable of inhibiting binding of TIGIT expressed by first T-cells with hCD155 expressed by second T-cells, eg, for reducing or suppressing IL-10 production in a subject for treating or preventing cancer or another disease or condition disclosed herein; and/or eg, for inhibiting reduction of IL-12 and IFN-γ secretion in a subject for treating or preventing cancer or another disease or condition disclosed herein. In an example, the first and/or second T-cells are CD4+ T-cells. In an example, the first and/or second T-cells are CD8+ T-cells.

36. The antibody, fragment or immunocytokine according to any preceding Statement wherein the antibody or fragment is capable of inhibiting binding of TIGIT with hCD155; hCD112; hCD113; hCD155 and hCD112; hCD155 and hCD113; or hCD155, hCD112 and hCD113, optionally for administration to a human or animal subject for treating a cancer of viral infection in said subject.

37. The antibody, fragment or immunocytokine according to any preceding Statement for treating a cancer in a human or animal subject by
    a. inhibiting the binding of TIGIT to CD155 in a tumour microenvironment;
    b. inhibiting P-Tyr and/or NFkβ signalling in TIGIT+ T- and/or NK cells;
    c. inhibiting tumour cell-mediated (eg, PD-L1-positive tumour cell-mediated) suppression of T- and/or NK cells in a tumour microenvironment of the cancer in a subject (eg, a human) suffering from the cancer; and/or
    d. reducing TIGIT-mediated inhibition of one or more T-cell factors in a tumour microenvironment of said cancer, wherein each factor is selected from T-bet, GATA3, IFN regulatory factor (IFR)4, RORc, IL-2 and IFN-γ.

An anti-TIGIT or fragment of the invention, for example, enhances T-cell and/or NK activity (eg, in vitro (such as for use as a diagonistic of a cancer or likelihood of treating a cancer using an antibody of the invention or another immune checkpoint inhibitor) or in a human or animal subject), but it can additionally or alternatively be used to target Tregs and reduce immune-suppressive signalling in the tumour microenvironment and/or to deplete Tregs.

In an example, the antibody or fragment specifically binds to TIGIT expressed by immune cells (eg, T and/or NK cells, eg, human cells, eg, cells comprised a human subject, eg, cells in vitro) and inhibits P-Tyr and/or NFkβ signalling in the cells. In an example the antibody or fragment specifically binds to TIGIT expressed by immune cells and reduce or inhibit IL-10 production (and optionally increases secretion of pro-inflammatory cytokines, eg, IL-12 and/or IFN-γ), such as in a tumour microenvironment (eg, any tumour in this paragraph). In an embodiment, the cells comprise memory and/or $T_{reg}$ cells. For example, the memory cells are CD4$^+$CD45RO$^+$ memory cells. For example, the memory cells are CD4$^+$CD25$^{hi}$ $T_{regs}$. For example, the $T_{reg}$ cells co-express Foxp3 and/or GITR in addition to TIGIT. For example, the T-cells comprise CD8$^+$ T cells; CD4$^+$ T cells; or CD4$^+$ and CD8$^+$ T cells, optionally wherein the cells are PD-1$^+$ or PD-1$^{high}$ For example, the T-cells comprise TILs (tumour infiltrating lymphocytes), eg, lung, colon, breast, uterine or renal tumour TILs in vitro or comprised by a patient (eg, a human) suffering from lung (eg, human non-small-cell carcinomas (NSCLC)), colon (eg, colon adenocarcinoma (COAD), breast, uterine (eg, uterine corpus endometroid carcicoma (UCEC)) or renal (eg, kidney renal cell carcinoma (KIRC)) cancer. For example, the TILs or T-cells are comprised by a patient suffering from a solid tumour. For example, a tumour herein is a PD-L1$^+$ or PD-L1$^{high}$ tumour. For example, the tumour is a TIGIT-negative (and optionally a PD-L1-positive) tumour. In an example, the antibody or fragment is for treating a cancer (such as a cancer mentioned herein or in this paragraph) by
    (a) inhibiting the binding of TIGIT to CD155 in a tumour microenvironment, optionally wherein the TIGIT is expressed by immune cells as mentioned in this paragraph; and/or
    (b) inhibiting P-Tyr and/or NFkβ signalling in TIGIT$^+$ cells, wherein the cells comprise any immune cells mentioned in this paragraph; and/or
    (c) reducing TIGIT-mediated inhibition of one or more T-cell factors in a tumour microenvironment, wherein each factor is selected from T-bet, GATA3, IFN regulatory factor (IFR)4, RORc, IL-2 and IFN-γ.

In an example, the CD155 is CD155 expressed on DCs (eg, DCs in a tumour microenvironment, eg wherein the tumour is a PD-L1-positive tumour). In an example, the CD155 is CD155 expressed on T-cells (eg, T-cells in a tumour microenvironment, eg wherein the tumour is a PD-L1-positive tumour) whose expression of one or more factors selected from T-bet, GATA3, IFN regulatory factor (IFR)4, RORc, IL-2 and IFN-γ is inhibited by TIGIT in the absence of inhibition of the binding of TIGIT to CD155 by the anti-TIGIT antibody or fragment of the invention. In an example, the antibody or fragment is for treating a cancer (such as a cancer mentioned herein or in this paragraph) by increasing production of IFN-γ mRNA by T-cells (eg, human CD4$^+$ T cells, eg, in a tumour microenvironment, such as a microenvironment or in a cancer disclosed in this paragraph. In an example, the antibody or fragment is for treating a cancer (such as a cancer mentioned herein or in this paragraph) by decreasing production of IL-10 mRNA by T-cells (eg, human CD4$^+$ T cells, eg, in a tumour microenvironment, such as a microenvironment or in a cancer disclosed in this paragraph. Any of the antibodies or fragments of the invention herein are for treating a cancer by inhibiting cancer cell-mediated (eg, PD-L1-positive cancer cell) suppression of the immune system of a patient (eg, a human) suffering from the cancer. In an embodiment, the suppression is suppression of T- and/or NK cells in a tumour microenvironment.

CD155 binds to TIGIT with a KD of 1-3 nM. In an example, advantageously the antibody or fragment of the invention binds TIGIT (eg, human TIGIT) with a KD of <1 nM, eg, <100, 90, 80, 70, 60, 50, 40, 30, 20, 10 or 1 μM. Optionally the KD is <1 nM, eg, <100, 90, 80, 70, 60, 50, 40, 30, 20, 10, wherein the KD is >1, 5 or 10 μM. In an embodiment, the KD of the antibody or fragment is determined by SPR or any other affinity determining technique disclosed herein. This may be useful for favouring TIGIT interaction with the antibody or fragment over TIGIT interaction with CD155.

Optionally, the CD155 is expressed on dendritic cells (DCs), fibroblasts and/or endothelial cells, eg, the CD155 is expressed on DCs in vitro or comprised by a patient suffering from a cancer. Wherein the CD155 is expressed on tumour cells, optionally colorectal carcinomas, gastric cancer and neuroblastoma cells.

In an example the antibody, fragment or immunocytokine of the invention is for treating cancer in a refractory patients, such as a patient that is non-responsive or poorly responsive to a different cancer therapy, such as chemotherapy or a different immune checkpoint inhibitor (eg, ipilimumab (Yervoy®), pembrolizumab (Keytruda®/MK-3475), nivolumab (Opdivo®/BMS-936558/MDX-1106), MEDI-0680/AMP514, PDR001 or Lambrolizumab).

In an example, the cancer is a solid or haematological tumour, eg, a solid tumour with immune-responsiveness e.g. melanoma, NSCLC.

38. An antibody, fragment or immunocytokine as defined in any preceding Statement for use in treating or preventing a TIGIT-mediated disease or condition, e.g. selected from neoplastic or non-neoplastic disease, chronic viral infections, and malignant tumours, such as melanoma, Merkel cell carcinoma, non-small cell lung cancer (squamous and non-squamous), renal cell cancer, bladder cancer, head and neck squamous cell carcinoma, mesothelioma, virally induced cancers (such as cervical cancer and nasopharyngeal cancer), soft tissue sarcomas, haematological malignancies such as Hodgkin's and non-Hodgkin's disease and diffuse large B-cell lymphoma (for example melanoma, Merkel cell carcinoma, non-small cell lung cancer (squamous and non-squamous), renal cell cancer, bladder cancer, head and neck squamous cell carcinoma and mesothelioma or for example virally induced cancers (such as cervical cancer and nasopharyngeal cancer) and soft tissue sarcomas).

In an example, the disease or condition is in a human. In an example, the disease or condition is in an animal.

In an example, the cancer is a lung, colon, uterine, breast or kidney cancer, eg, lung (LUSC), non-small-cell carcinomas (NSCLC), colon adenocarcinoma (COAD), uterine corpus endometroid carcicoma (UCEC), breast (BRCA) or kidney renal cell carcinoma (KIRC).

39. Use of an antibody, fragment or immunocytokine as defined in any one of Statements 1 to 37 in the manufacture of a medicament for administration to a human for treating or preventing a TIGIT mediated disease or condition in the human, e.g. selected from neoplastic or non-neoplastic disease, chronic viral infections, and malignant tumours, such as melanoma, Merkel cell carcinoma, non-small cell lung cancer (squamous and non-squamous), renal cell cancer, bladder cancer, head and neck squamous cell carcinoma, mesothelioma, virally induced cancers (such as cervical cancer and nasopharyngeal cancer), soft tissue sarcomas, haematological malignancies such as Hodgkin's and non-Hodgkin's disease and diffuse large B-cell lymphoma (for example melanoma, Merkel cell carcinoma, non-small cell lung cancer (squamous and non-squamous), renal cell cancer, bladder cancer, head and neck squamous cell carcinoma and mesothelioma or for example virally induced cancers (such as cervical cancer and nasopharyngeal cancer) and soft tissue sarcomas).

40. A method of treating or preventing a TIGIT mediated disease or condition, e.g. selected from neoplastic or non-neoplastic disease, chronic viral infections, and malignant tumours, such as melanoma, Merkel cell carcinoma, non-small cell lung cancer (squamous and non-squamous), renal cell cancer, bladder cancer, head and neck squamous cell carcinoma, mesothelioma, virally induced cancers (such as cervical cancer and nasopharyngeal cancer), soft tissue sarcomas, haematological malignancies such as Hodgkin's and non-Hodgkin's disease and diffuse large B-cell lymphoma (for example melanoma, Merkel cell carcinoma, non-small cell lung cancer (squamous and non-squamous), renal cell cancer, bladder cancer, head and neck squamous cell carcinoma and mesothelioma or for example virally induced cancers (such as cervical cancer and nasopharyngeal cancer) and soft tissue sarcomas) in a human, comprising administering to said human a therapeutically effective amount of an antibody, fragment or immunocytokine as defined in any one of Statements 1 to 37, wherein the TIGIT mediated disease or condition is thereby treated or prevented.

41. The antibody, fragment or immunocytokine according to Statement 38, the use according to Statement 39 or the method according to Statement 40, wherein the TIGIT-mediated disease or condition is cancer.

Optionally, a DNAM-1 agonist is further administered to the subject simultaneously or sequentially with the anti-TIGIT antibody, fragment or immunocytokine of the invention. This is useful for enhancing the desirable immune effect of DNAM-1 and inhibiting TIGIT-mediated suppression of T-cells and/or NK cells as discussed herein.

42. The antibody, fragment or immunocytokine, use or method according to Statement 41, wherein the cancer is selected from melanoma, Merkel cell carcinoma, non-small cell lung cancer (squamous and non-squamous), renal cell cancer, bladder cancer, head and neck squamous cell carcinoma and mesothelioma or is selected from virally induced cancers (such as cervical cancer and nasopharyngeal cancer) and soft tissue sarcomas.

43. The antibody, fragment or immunocytokine according to Statement 38, the use according to Statement 39 or the method according to Statement 40, wherein the TIGIT-mediated disease or condition is a neurodegenerative disease, disorder or condition, e.g. selected from Alzheimer's disease, amyotrophic lateral sclerosis, Parkinson's disease, Huntington's disease, primary progressive multiple sclerosis, secondary progressive multiple sclerosis, corticobasal degeneration, Rett syndrome, a retinal degeneration disorder selected from age-related macular degeneration and retinitis pigmentosa; anterior ischemic optic neuropathy, glaucoma, uveitis, depression, trauma-associated stress or post-traumatic stress disorder, frontotemporal dementia, Lewy body dementias, mild cognitive impairments, posterior cortical atrophy, primary progressive aphasia and progressive supranuclear palsy or aged-related dementia, in particular, the neurodegenerative disease, disorder or condition is selected from Alzheimer's disease, amyotrophic lateral sclerosis, Parkinson's disease and Huntington's disease, for example, Alzheimer's disease.

44. The antibody, fragment, immunocytokine method or use according to any one of Statements 36 to 43 wherein the cancer, disease or condition is a PD-L1 positive cancer, disease or condition, optionally wherein a PD-L1 inhibitor (eg, an anti-PD-L1 antibody, fragment or immunocytokine) is administered to the subject simultaneously or sequentially with the anti-TIGIT antibody, fragment of immunocytokine.

45. The antibody, fragment, immunocytokine, use or the method according to any one of Statements 30 to 33 and 36 to 44, further comprising administering to the human or subject a further therapy, for example a further therapeutic agent, optionally wherein the further therapeutic agent is selected from the group consisting of:
   a) immune checkpoint inhibitors (such as anti-TIM-3 antibodies, anti-CTLA-4 antibodies, anti-PD-L1 antibodies, anti-PD-1 antibodies and anti-LAG-3 antibodies);
   b) immune stimulators (such as anti-OX40 antibodies, anti-GITR antibodies, anti-CD137 antibodies, anti-ICOS antibodies and anti-CD40 antibodies);
   c) chemokine receptor antagonists (such as CXCR4, CCR4 and CXCR2);
   d) targeted kinase inhibitors (such as CSF-1R or VEGFR inhibitors);
   e) angiogenesis inhibitors (such as anti-VEGF-A or Delta-like Ligand-4);
   f) immune stimulating peptides or chemokines (such as CXCL9 or CXCL10);
   g) cytokines (such as IL-15 and IL-21);
   h) bispecific T-cell engagers (BiTEs) having at least one specificity against CD3 (e.g. CD3/CD19 BiTE);
   i) other bi-specific molecules (for example IL-15-containing molecules targeted towards tumour associated antigens, for example Epidermal growth factor receptors such as EGFR, Her-2, New York Esophageal Cancer-1 (NY-ESO-1), GD2, EpCAM or Melanoma Associated Antigen-3 (MAGE-A3));
   j) oncolytic viruses (such as HSV virus (optionally which secretes GMCSF), Newcastle disease virus and Vaccinia virus);
   k) vaccination with tumour associated antigens (such as New York Esophageal Cancer-1 [NY-ESO-1], Melanoma Associated Antigen-3 [MAGE-3]);
   l) cell-based therapies (such as chimeric Antigen Receptor-T-cells (CAR-T) for example expressing anti-CD19, anti-EpCam or anti-mesothelin); and
   m) adoptive transfer of tumour specific T-cells or LAK cells, or optionally wherein the further therapy is chemotherapy, radiotherapy and surgical removal of tumours.

46. A pharmaceutical composition comprising an antibody, fragment or immunocytokine as defined in any one of Statements 1 to 38 and 41 to 45 and a pharmaceutically acceptable excipient, diluent or carrier and optionally in combination with a further therapeutic agent selected from the group consisting of:
   a) other immune checkpoint inhibitors (such as anti-TIM-3 antibodies, anti-CTLA-4 antibodies, anti-PD-L1 antibodies, anti-PD-1 antibodies and anti-LAG-3 antibodies);
   b) immune stimulators (such as anti-OX40 antibodies, anti-GITR antibodies, anti-CD137 antibodies, anti-ICOS antibodies and anti-CD40 antibodies);
   c) chemokine receptor antagonists (such as CXCR4, CCR4 and CXCR2);
   d) targeted kinase inhibitors (such as CSF-1R or VEGFR inhibitors);
   e) angiogenesis inhibitors (such as anti-VEGF-A or Delta-like Ligand-4);
   f) immune stimulating peptides or chemokines (such as CXCL9 or CXCL10);
   g) cytokines (such as IL-15 and IL-21);
   h) bispecific T-cell engagers (BiTEs) having at least one specificity against CD3 (e.g. CD3/CD19 BiTE);
   i) other bi-specific molecules (for example IL-15-containing molecules targeted towards tumour associated antigens, for example Epidermal growth factor receptors such as EGFR, Her-2, New York Esophageal Cancer-1 (NY-ESO-1), GD2, EpCAM or Melanoma Associated Antigen-3 (MAGE-A3));
   j) oncolytic viruses (such as HSV virus (optionally which secretes GMCSF), Newcastle disease virus and Vaccinia virus);
   k) vaccination with tumour associated antigens (such as New York Esophageal Cancer-1 [NY-ESO-1], Melanoma Associated Antigen-3 [MAGE-3]);
   l) cell-based therapies (such as chimeric Antigen Receptor-T-cells (CAR-T) for example expressing anti-CD19, anti-EpCam or anti-mesothelin); and
   m) adoptive transfer of tumour specific T-cells or LAK cells.

47. A pharmaceutical composition comprising the antibody, fragment or immunocytokine of any one of Statements 1 to 38 and 41 to 46, in combination with a further antibody or fragment, wherein the further antibody or fragment specifically binds
   i. human PD-L1 and optionally comprises the VH, VL, the VH and VL, heavy chain, light chain, or heavy and light chains of an antibody selected from 1D05, 84G09, 413G05 and 416E01; or
   ii. human ICOS and optionally comprises the VH, VL, the VH and VL, heavy chain, light chain, or heavy and light chains of an antibody selected from STIM003, STIM001; or wherein the further antibody or fragment is any anti-PD-L1 or anti-ICOS antibody or fragment disclosed herein.

In an example, said selected antibody is 1D05. In an example, said selected antibody is 84G09. In an example, said selected antibody is STIM003.

In an example, the invention provides a pharmaceutical composition comprising the antibody, fragment or immunocytokine of any preceding Statement, in combination with a further antibody or fragment, wherein the further antibody or fragment specifically binds an immune checkpoint inhibitor, immune modulator or immune activator, eg, any immune checkpoint inhibitor, immune modulator or immune activator disclosed herein or in any reference incorporated herein by reference. Optionally, the further antibody or fragment is any anti-PD-L1 or anti-ICOS antibody or fragment disclosed herein.

48. The pharmaceutical composition according to Statement 46 or 47, or a kit comprising a pharmaceutical composition as defined in Statement 46 or 47, wherein the composition is for treating and/or preventing a TIGIT-mediated condition or disease, e.g. selected from neoplastic or non-neoplastic disease, chronic viral infections, and malignant tumours, such as melanoma, Merkel cell carcinoma, non-small cell lung cancer (squamous and non-squamous), renal cell cancer, bladder cancer, head and neck squamous cell carcinoma, mesothelioma, virally induced cancers (such as cervical cancer and nasopharyngeal cancer), soft tissue sarcomas, haematological malignancies such as Hodgkin's and non-Hodgkin's disease, diffuse large B-cell lymphoma.

49. A pharmaceutical composition according to Statement 46 or 47, or a kit comprising a pharmaceutical composition as defined in Statement 46 or 47, wherein the composition is for treating and/or preventing a neurodegenerative disease, disorder or condition, e.g. selected from Alzheimer's disease, amyotrophic lateral sclerosis, Parkinson's disease, Huntington's disease, primary progressive multiple sclerosis, secondary progressive multiple sclerosis, corticobasal degeneration, Rett syndrome, a retinal degeneration disorder selected from age-related macular degeneration and retinitis pigmentosa; anterior ischemic optic neuropathy, glaucoma, uveitis, depression, trauma-associated stress or post-traumatic stress disorder, frontotemporal dementia, Lewy body dementias, mild cognitive impairments, posterior cortical atrophy, primary progressive aphasia and progressive supranuclear palsy or aged-related dementia, in particular, the neurodegenerative disease, disorder or condition is selected from Alzheimer's disease, amyotrophic lateral sclerosis, Parkinson's disease and Huntington's disease, for example, Alzheimer's disease 50. The pharmaceutical composition according to any one of Statements 46 to 49 in combination with, or kit according to Statement 48 or Statement 49 comprising, a label or instructions for use to treat and/or prevent said disease or condition in a human; optionally wherein the label or instructions comprise a marketing authorisation number (e.g., an FDA or EMA authorisation number); optionally wherein the kit comprises an IV or injection device that comprises the antibody or fragment.

51. A nucleic acid (eg, DNA, RNA, cDNA or mRNA) that encodes a $V_H$ domain and/or a $V_L$ domain of an antibody or fragment as defined in any one of Statements 1 to 24.

52. A nucleic acid (eg, DNA, RNA, cDNA or mRNA) (eg, according to Statement 51) comprising
    (a) a nucleotide sequence that is at least 95% identical to the sequence of SEQ ID NO: 604, 624, 644, 664, 678, 682, 686, 690, 694, 698, 702, 706, 710, 714, 718, 722, 726, 730, 734, 738, 742, 746 or 750; and/or
    (b) a nucleotide sequence that is at least 95% identical to the sequence of SEQ ID NO: 614, 634, 654, 674, 680, 684, 688, 692, 696, 700, 704, 708, 712, 716, 720, 724, 728, 732, 736, 740, 744, 748 or 752.

In one embodiment, the nucleic acid sequence is at least 70% identical to the specified SEQ ID NO. In one embodiment, the nucleic acid sequence is at least 75% identical to the specified SEQ ID NO. In one embodiment, the nucleic acid sequence is at least 95% identical to the specified SEQ ID NO. In one embodiment, the nucleic acid sequence is at least 96% identical to the specified SEQ ID NO. In one embodiment, the nucleic acid sequence is at least 97% identical to the specified SEQ ID NO. In one embodiment, the nucleic acid sequence is at least 98% identical to the specified SEQ ID NO. In one embodiment, the nucleic acid sequence is at least 99% identical to the specified SEQ ID NO. In one embodiment, the nucleic acid sequence is at least 99.5% identical to the specified SEQ ID NO.

For example, the nucleic acid comprises the a nucleotide sequence encoding a VH domain of KY01 and/or a nucleotide sequence encoding a VL domain of KY01.

For example, the nucleic acid comprises the a nucleotide sequence encoding a VH domain of KY02 and/or a nucleotide sequence encoding a VL domain of KY02.

For example, the nucleic acid comprises the a nucleotide sequence encoding a VH domain of KY03 and/or a nucleotide sequence encoding a VL domain of KY03.

For example, the nucleic acid comprises the a nucleotide sequence encoding a VH domain of KY04 and/or a nucleotide sequence encoding a VL domain of KY04.

The invention also provides:—

51a. A nucleic acid (eg, DNA, RNA, cDNA or mRNA) that encodes a heavy chain of an antibody or fragment as defined in any one of Statements 1 to 24.

51b. A nucleic acid (eg, DNA, RNA, cDNA or mRNA) (eg, according to Statement 51a) comprising a nucleotide sequence that is at least 70% identical to the sequence of SEQ ID NO: 606, 626, 646 or 666.

51c. A nucleic acid (eg, DNA, RNA, cDNA or mRNA) that encodes a light chain of an antibody or fragment as defined in any one of Statements 1 to 24.

51d. A nucleic acid (eg, DNA, RNA, cDNA or mRNA) (eg, according to Statement 51c) comprising a nucleotide sequence that is at least 70% identical to the sequence of SEQ ID NO: 616, 636, 656 or 676.

53. A nucleic acid that encodes a heavy chain or a light chain of an antibody as defined in any one of Statements 1 to 24.

54. A vector comprising the nucleic acid of any one of Statements 51 to 53; optionally wherein the vector is a CHO or HEK293 vector.

55. A host cell comprising the nucleic acid of any one of Statements 32 to 34 or the vector of Statement 54.

In these Statements, antibodies or fragments may include or may not include bispecific antibodies. In one embodiment, in these Statements, antibodies or fragments includes bispecific antibodies. In one embodiment, the bispecific antibody is in a FIT-Ig or mAb$^2$ format. In one embodiment, a bispecific antibody does not include a FIT-Ig format. In one embodiment, a bispecific antibody does not include a mAb$^2$ format. In one embodiment, a bispecific antibody does not include either a FIT-Ig format or a mAb$^2$ format. In one embodiment, the antibody or fragment in these Statements includes a bispecific antibody, but does not include a bispecific antibody having a FIT-Ig format. In one embodiment, the antibody or fragment in these Statements includes a bispecific antibody, but does not include a bispecific antibody having a mAb$^2$ format. In one embodiment, the antibody or fragment in these Statements includes a bispecific antibody, but does not include a bispecific antibody having a FIT-Ig format or a mAb$^2$ format. In another embodiment, in these Statements, antibodies or fragments include dual binding antibodies. Such formats are described above in relation to anti-PD-L1 antibodies and such disclosures apply mutatis mutandis to the present anti-TIGIT antibodies and fragments.

Preferably, an antibody or a fragment thereof that specifically binds to a hTIGIT does not cross-react with other antigens (but may optionally cross-react with TIGIT of a different species, e.g., rhesus, cynomolgus, or murine). An antibody or a fragment thereof that specifically binds to a TIGIT antigen can be identified, for example, by immunoassays, BIAcore™, or other techniques known to those of skill in the art. An antibody or a fragment thereof binds specifically to a hTIGIT antigen when it binds to a hTIGIT antigen with higher affinity than to any cross-reactive antigen as determined using experimental techniques, such as radioimmunoassays (RIA) and enzyme-linked immunosorbent assays (ELISAs). Typically, a specific or selective reaction will be at least twice background signal or noise and more typically more than 10 times background. See, e.g. Paul, ed., 1989, Fundamental Immunology Second Edition, Raven Press, New York at pages 332-336 for a discussion regarding antibody specificity.

As provided in the Statements or aspects herein, an anti-TIGIT antibody or immunocytokine may bind to TIGIT, e.g. human TIGIT with a $K_D$ of less than 50 nM, less than 40 nM, less than 30 nM as determined by surface plasmon resonance. Another embodiment, anti-TIGIT antibody or immunocytokine may bind to TIGIT, e.g. human TIGIT with a $K_D$ of less than 20 nM, less than 15 nM, less than 10 nM as determined by surface plasmon resonance. anti-PD-L1 antibody or immunocytokine may bind to TIGIT, e.g. human TIGIT with a $K_D$ of less than 8 nM, less than 5 nM, less than 4 nM, less than 3 nM, less than 2 nM or less than 1 nM as determined by surface plasmon resonance. The $K_D$ may be 0.9 nM or less, 0.8 nM or less, 0.7 nM or less, 0.6 nM or less, 0.5 nM or less, 0.4 nM or less, 0.3 nM or less, 0.2 nM or less, or 0.1 nM or less.

In another embodiment, the $K_D$ is within a range of 0.01 to 1 nM, or a range of 0.05 to 2 nM, or a range of 0.05 to 1 nM. The $K_D$ may be with regard to hTIGIT, cynomolugus monkey (ie, "cyno") TIGIT and/or mouse TIGIT.

In another embodiment, the anti-TIGIT antibodies described herein have a $K_{ON}$ rate (e.g. as measured by SPR, e.g. at 25° C. or at 37° C.) of approximately 0.5 to 10 μM, for example approximately 1 to 8 μM or approximately 1 to 7 μM. In another embodiment, the $K_{ON}$ rate is approximately 1 to 5 μM, e.g. approximately 1 μM, approximately 1.5 μM, approximately 2 μM, approximately 2.5 μM or approximately 3 μM. In another embodiment, the $K_{ON}$ rate is approximately 3.5 μM, approximately 4 μM, approximately 4.5 μM, approximately 5 μM or approximately 5.5 μM.

In another embodiment, the anti-TIGIT antibodies described herein have a $K_{OFF}$ rate (e.g. as measured by SPR, e.g. at 25° C. or at 37° C.) of approximately 0.01 to 100 mM, for example approximately 0.1 to 50 mM or approximately 0.5 to 50 mM. In another embodiment, the $K_{OFF}$ rate is approximately 0.5 to 10 mM, or approximately 0.5 to 10 mM, e.g. approximately 1 mM, approximately 2 mM, approximately 3 mM, approximately 4 mM or approximately 5 mM. In another embodiment, the $K_{OFF}$ rate is approximately 0.6 mM, approximately 0.7 mM, approximately 0.8 mM or approximately 0.9 mM.

Contact amino acid residues involved in the interaction of antibody and antigen, such as TIGIT, may be determined by various known methods to those skilled in the art.

In one embodiment, sequential replacement of the amino acids of the antigen sequence as described above for PD-L1 is used mutatis mutandis in the present invention relating to TIGIT.

In one embodiment, protein crystallography to determine contact residues between antibody and antigen (i.e. to determine the epitope to which the antibody binds) as described above for PD-L1 is used in the present invention relating to TIGIT.

In one embodiment, if the antibody recognises a linear epitope, short peptides based on the antigen sequence can be produced and binding of the antibody to these peptides can be assessed using standard techniques, as described above for PD-L1 is used in the present invention relating to TIGIT.

In one embodiment, limited proteolytic digestion and mass spectrophotometry can be used to identify binding epitopes as described above for PD-L1 is used in the present invention relating to TIGIT.

In one embodiment, the contact residues of the epitope are identified by X-ray crystallography. In one embodiment, the contact residues of the epitope are identified by cryo-electro microscopy. In one embodiment, the contact residues of the epitope are identified by a combination of limited proteolytic digestion and mass spectrometry.

In another embodiment, the anti-TIGIT antibodies (and immunocytokines) described in herein provide improved transient expression levels over other anti-TIGIT antibodies and immunocytokines. Thus, in one embodiment, the anti-TIGIT antibody (or immunocytokine) is expressed in a HEK293 cell, e.g. a HEK293T cell, at an expression level of approximately 100 μg/mL, or in a range of approximately 100 to 350 μg/mL. In another embodiment, the expression level is above approximately 350 μg/mL.

In another embodiment, the anti-TIGIT antibody (or immunocytokine) is expressed in a CHO cell, e.g. an Expi-CHO cell, at an expression level of approximately 100 μg/mL, or in a range of approximately 100 to 350 μg/mL. In another embodiment, the expression level is above approximately 350 μg/mL.

In another embodiment, the anti-TIGIT antibody (or immunocytokine) is expressed in a CHO cell, e.g. an Expi-CHO cell or a CHO-E7 EBNA cell, at an expression level of approximately 100 μg/mL, or in a range of approximately 100 to 350 μg/mL. In another embodiment, the expression level is above approximately 350 μg/mL. The antibody for example, comprises the $V_H$ and $V_L$ domains of any one of KY01-23 (eg, KY01), formatted as a human IgG1 or human IgG4.

In any of these expression systems, the expression is carried out of a scale of between approximately 0.5 mL and 3 mL, for example between approximately 0.5 mL and 2 mL. In any of these expression systems, the anti-TIGIT antibody (or immunocytokine) may be expressed from a pTT5 vector. In any of these expression systems, the anti-TIGIT antibody (or immunocytokine) may be expressed in conjunction with a lipid transfection reagent, and may optionally be expressed in a CHO cell, e.g. an Expi-CHO cell. In any of these expression systems, the anti-TIGIT antibody (or immunocytokine) may be expressed in conjunction with a PEI transfection reagent, and may optionally be expressed in a CHO cell, e.g. an CHO-E7 EBNA cell. In any of these expression systems, the anti-TIGIT antibody (or immunocytokine) may be expressed in conjunction with a helper plasmid (e.g. an AKT helper plasmid), and may optionally be expressed in a CHO cell, e.g. an CHO-E7 EBNA cell.

In any of these expression systems, the expression level is between approximately 100 μg/mL and approximately 1500 μg/mL, for example between approximately 100 μg/mL and approximately 1000 μg/mL, or between approximately 200 μg/mL and approximately 1000 μg/mL, or between approximately 350 μg/mL and approximately 1000 μg/mL. In any of these expression systems, the lower limit of expression may be approximately 100 μg/mL, approximately 200 μg/mL, approximately 300 μg/mL, or approximately 400 μg/mL. In another embodiment, the lower limit of expression may be approximately 500 μg/mL, approximately 600 μg/mL, approximately 700 μg/mL, or approximately 800 μg/mL. In any of these expression systems, the upper limit of expression may be approximately 2000 μg/mL, approximately 1800 μg/mL, approximately 1600 μg/mL, or approximately 1500 μg/mL. In another embodiment, the upper limit of expression may be approximately 1250 μg/mL, approximately 1000 μg/mL, approximately 900 μg/mL, or approximately 800 μg/mL.

In another embodiment, the expression system is a Lonza expression system, e.g. Lonza X-Ceed® system. In the Lonza expression system, the expression may be carried out at a scale of approximately 30 mL to 2 L, for example 50 mL to 1 L, or 1 L tp 2 L. In the Lonza expression system, the anti-TIGIT antibody (or immunocytokine) may be expressed in conjunction with electroporation, and optionally without any helper plasmids. In the Lonza expression system, the anti-TIGIT antibody (or immunocytokine) may be expressed at a level of approximately 1 g/L, or approximately 900 mg/L, or approximately 800 mg/L, or approximately 700 mg/L. In another embodiment, In the Lonza expression system, the anti-TIGIT antibody (or immunocytokine) may be expressed at a level of approximately 600 mg/L or approximately 500 mg/L or approximately 400 mg/L. In the Lonza expression system, the anti-TIGIT antibody (or immunocytokine) may be expressed at a level of between approximately 400 mg/L and approximately 2 g/L, for example between approximately 500 mg/L and approximately 1.5 g/L, or between approximately 500 mg/L and approximately 1 g/L. In another embodiment, the expression level is above 1 g/L. In another embodiment, the anti-TIGIT antibodies provide improved half-life over other anti-TIGIT antibodies.

in one embodiment, the antibody or fragment is a human antibody or fragment. In one embodiment, the antibody or fragment is a fully human antibody or fragment. In one embodiment, the antibody or fragment is a fully human monoclonal antibody or fragment.

Contact amino acid residues involved in the interaction of antibody and antigen may be determined by various known methods to those skilled in the art, such as alanine scanning, protein crystallography, mass spectrophometry or any other technique described herein for anti-PD-L1 antibodies. The features of such disclosures apply mutatis mutandis to anti-TIGIT antibodies, fragments and immunocytokines on the invention.

The anti-TIGIT immunocytokine (ICK), antibody or fragment according to the invention may comprise a constant region, such as a human constant region, for example an effector-null human constant region, e.g. an IgG4 constant region or an IgG1 constant region, optionally wherein the constant region is IgG4-PE (Seq ID No:199), or a disabled IgG1 as defined in Seq ID No:205.

In other embodiments, the ICK, antibody or fragment is any of the isotypes or constant regions as defined hereinabove. In one embodiment, the constant region is wild-type human IgG1 (Seq ID No:340). For example, the constant region is an effector-enabled IgG1 constant region, optionally having ADCC and/or CDC activity. In one embodiment, the constant region is engineered for enhanced ADCC and/or CDC and/or ADCP. In another embodiment, the constant region is engineered for enhanced effector function.

The IgG4 constant region may be any of the IgG4 constant region amino acid sequences, or encoded by any of the nucleic acid sequences of Seq ID Nos:192 to 203. A heavy chain constant region may be an IgG4 comprising both the Leu235Glu mutation and the Ser228Pro mutation. This "IgG4-PE" heavy chain constant region (Seq ID Nos: 199, encoded by Seq ID Nos:198, 200 and 201) is effector null.

An alternative effector null human constant region is a disabled IgG1 being an IgG1*01 allele comprising the L235A and/or G237A mutations (e.g. LAGA, Seq ID No:205, encoded by Seq ID No:204). In one embodiment, the antibodies or antibody fragments disclosed herein comprise an IgG1 heavy chain constant region, wherein the sequence contains alanine at position 235 and/or 237 (EU index numbering).

The potency of Fc-mediated effects may be enhanced by engineering the Fc domain by any of the techniques described herein for anti-PD-L1 antibodies. In another embodiment, the increase in affinity for Fc-receptors using any of the techniques described herein for anti-PD-L1 antibodies. In another embodiment, the antibodies and fragments disclosed herein may comprise a triple mutation (M252Y/S254T/T256E) which enhances binding to FcRn. The enhancement of CDC may be achieved by any of the techniques described herein for anti-PD-L1 antibodies. These disclosures and all others described herein for engineering the constant regions of anti-PD-L1 antibodies apply mutatis mutandis to the anti-TIGIT ICKs, antibodies and fragments of the invention.

In an example, the antibody is a human IgG4 antibody that is capable of inhibiting the interaction with CD155 to enhance T-cell and/or NK anti-tumour activity in a subject for treating cancer.

In an example, the antibody is a human IgG1 antibody for binding TIGIT expressed on Tregs and/or tumour cells in a subject for treating cancer and/or for reducing immune-suppressive signalling in the tumour microenvironment.

In an example, the anti-TIGIT ICKs, antibodies and fragment of the invention comprises a murine constant region. In other embodiments, the constant region may be of any non-human mammalian origin, e.g. rat, mouse, hamster, guinea pig, dog, cat, horse, chicken, llama, dromedary, etc. In one embodiment, the constant region is a rat constant region. In another embodiment, the constant region is a llama constant region. The murine constant region may be any of the isotypes or alleles described hereinabove.

10. Examples

Example 1—Antigen Preparation, Immunization Procedures, and Hybridoma Generation The following example provides a detailed description of the generation and identification of a panel of anti-human PD-L1 monoclonal antibodies using the KyMouse™ system (see, e.g., WO2011/004192, WO2011/158009 and WO2013/061098). To this end, genetically engineered mice containing a large number of human immunoglobulin genes were immunized with soluble recombinant human PD-L1 or surface expressed human PD-L1 displayed on mouse embryonic fibroblast (MEF) cells. Various immunization regimens, including conventional intraperitoneal injections as well as a rapid immunisation at multiple sites (RIMMS) regimen were set up, boosting animals over several weeks (see detailed methods below). At the end of each regimen, secondary lymphoid tissue such as the spleen, and in some cases, the lymph nodes were removed. Tissues were prepared into a single cell suspension and fused with SP2/0 cells to generate a stable hybridoma cell line.

Materials and Methods a) Generation of Stably Transfected MEF and CHO-S Cells Expressing Human PD-L1:

Full length human PD-L1 sequence (SEQ ID No:1 also known as B7-H1) was codon optimized for mammalian expression and cloned into an expression vector under the CMV promoter flanked by 3' and 5' piggyBac specific terminal repeat sequences, facilitating stable integration into the cell genome (see: "A hyperactive piggyBac transposase for mammalian applications"; Yusa K., et al., Proc. Natl. Acad. Sci. USA., 108(4): 1531-6, 2011 Jan. 25). Furthermore, the expression vector contained a puromycin selection cassette to facilitate stable cell line generation. The human PD-L1 expression plasmid was co-transfected with a plasmid encoding piggyBac transposase into an in-house derived mouse embryonic fibroblast (MEF) cell line (embryos used to generate this line were obtained from a 12955 crossed to C57/BL6 female mouse) and CHO-S cells using the FreeStyle Max transfection reagent (Invitrogen) according to manufacturer instructions. 24 hours after transfection, the media was supplemented with puromycin and grown for at least two weeks to select a stable cell line with complete medium being exchanged every 3 to 4 days. The expression of hPD-L1 was assessed by flow cytometry using an anti-human PD-L1-PE conjugated antibody (eBioscience). Complete MEF media was made up of Dulbecco's Modified Eagle's Medium (Gibco) supplemented with 10% v/v fetal bovine serum (Gibco). Complete CHO-S media was made up of CD-CHO media (Gibco) supplemented with 8 mM Glutamax (Gibco). Transfected CHO cells were used for screening purposes (see Example 2).

b) Preparation of MEF Cells for Mouse Immunizations:

Cell culture medium was removed and cells washed once with 1×PBS. Cells were treated for 5 minutes with trypsin to loosen cells from tissue culture surface. Cells were collected and trypsin neutralized by the addition of complete MEF media. Cells were then centrifuged at 300 g for 10 minutes and washed with 25 mL of 1×PBS. Cells were counted and resuspended at the appropriate concentration in ix PBS.

c) Immunisations with PD-L1

Genetically engineered Kymouse™ HK strain, containing human immunoglobulin genes producing human kappa (HK) light chain antibodies (Lee et al., Nature Biotechnology, 32, 6-363, 2014) were immunized by various immunisation regimens for the generation of human anti-PD-L1 antibodies.

Mice were immunised either with soluble recombinant hPD-L1 (R&D Systems, 156-B7, Fc chimera) using a modified sub-cutaneous immunisation procedure (RIMMS; modified after Kilpatrick et al., "Rapid development of affinity matured monoclonal antibodies using RIMMS"; Hybridoma. 1997 August; 16(4):381-9, hereafter referred to as KM031), or by using soluble recombinant hPD-L1 in a prime-rest-boost regime by sub-cutaneous administration (hereafter referred to as KM032) or by combination of soluble recombinant hPD-L1 and stably transfected MEF cells expressing hPD-L1 administered intra-peritoneally (hereafter referred to as KM033). Sigma Adjuvant System was used for all immunisations and rest intervals were usually between 2 and 3 weeks. Where protein was used as the immunogen, CpG (Hokkaido System Science) was also administered. Serum from serial or terminal blood samples were analysed for the presence of specific antibodies by ELISA and flow cytometry and the titre data was used (where possible) to select mice to be used for hybridoma fusions. A further regimen, KM042 immunising with MEF-PD-L1 cells alone, or protein alone in a prime-rest-boost setting, was also performed, but out of six antibodies confirmed to bind to hPD-L1, no neutralising antibodies were identified.

d) Cloning and Expression of Recombinant Proteins

DNA sequences encoding PD-L1 were purchased as synthetic DNA strings and cloned into appropriate mammalian expression vectors for transient expression in Expi293 and CHO cells. The sequence listing shows the sequences of the antigens, where available, and affinity tags for purification/labelling (shown in bold and underlined), see Seq ID Nos:3 to 6.

e) Determining Serum Titre by Reverse PD-L1 ELISA Protocol

Titres in mouse serum samples were determined using a reverse PD-L1 ELISA protocol. Anti-mouse IgG capture antibody (Southern Biotech) (4 µg/mL diluted in PBS, 50 µL/well) was adsorbed to 96 well low auto-fluorescent, high protein binding plates (Costar) overnight at 4° C. Excess IgG was removed by washing three times with PBS-Tween (0.1% v/v) and the wells were blocked with 1% w/v bovine serum albumin (BSA, Sigma) in PBS for 1 hour at room temperature, after which plates were washed three times with PBS-Tween (0.1% v/v). Serial ten-fold dilutions of mouse serum were prepared, diluting samples in reagent diluent (0.1% w/v BSA/PBS). 50 µL/well of this titration was then added to ELISA plates. To determine the change in activity level due to immunization, serum from each animal prior to immunization was diluted to 1/100 in reagent diluent and 50 µL/well added to the ELISA plate. Following incubation, plates were washed as before to remove unbound proteins. Biotinylated hPD-L1-his (in-house generated protein, Seq ID No: 3, labelled in-house using Sulfo-NHS-LC-Biotin (Thermo)), used at 100 ng/mL in reagent diluent; 50 µL/well) was then added to the plates and incubated at room temperature for 1 hour. Unbound biotinylated hPD-L1 was removed by washing with PBS-Tween (0.1% v/v), while the remaining biotinylated hPD-L1 was detected by addition of streptavidin-HRP (Sigma) diluted 1/10,000 in reagent diluent. Following incubation for 1 hour at room temperature, plates were washed as described before and 50 µL TMB (Sigma) was added to the plate. The reaction was stopped by adding 50 µL 1M sulphuric acid (Fluka Analytical). The OD at 450 nm was measured on an Envision plate reader (PerkinElmer). Titres were not performed for KM032 as only one mouse was immunised. For KM031, titres were performed on terminal bleeds only.

f) Determination of Serum Titres by Flow Cytometry Using CHO-S Expressed hPD-L1

CHO-S cells expressing hPD-L1, suspended in FACS buffer (PBS+1% w/v BSA+0.1% w/v sodium azide) were distributed to a 96-well, V-bottom plate (Greiner) at a density of $10^5$ cells per well. A titration of mouse serum was prepared, diluting samples in FACS buffer. 25 µL/well of this titration was then added to the cell plate. To determine the change in activity level due to immunization, serum from each animal prior to immunization was diluted to 1/100 in FACS buffer and 25 µL/well added to the cells. Cells were incubated at 4° C. for 1 hour. Cells were washed twice with 150 µL PBS, centrifuging after each wash step and aspirating supernatant (centrifuged at 300×g for 3 minutes). To detect antibody binding, PE goat-anti-mouse IgG (Jackson ImmunoResearch) was diluted 1/500 in FACS buffer and 50 µL was added to the cells. Cells were incubated 1 hour at 4° C. in the dark, then washed twice with 150 µL PBS as above. To fix cells, 100 µL 2% v/v paraformaldehyde was added and cells incubated for 30 minutes at 4° C. Cells were then pelleted by centrifugation at 300×g and the plates resuspended in 100 µL of FACS buffer. PE signal intensity (geometric mean) was measured by flow cytometry using a BD FACS Array instrument. Titres were performed by this method for KM033 only.

q) Murine Tissue Isolation and Preparation

Following final boost, mice were culled and spleens were excised from immunized mice, washed in 1×PBS and kept on ice until further processing. Tissues were prepared in buffer containing 1×PBS (Invitrogen) and 3% heat-inactivated FBS (Invitrogen). Splenocytes were dispersed by mashing the tissue through a 45 µm strainer (BD Falcon) and rinsing with 30 mL 3% FBS/PBS buffer before centrifugation at 700 g for 10 minutes at 4° C. To remove red blood cells, the pelleted splenocytes were resuspended in 4 mL Red Blood Cell Lysis Buffer (Sigma). After 4 minutes of incubation, the lysis reaction was stopped by addition of 3%

FBS/1×PBS buffer. Cell clumps were filtered out with a 45 µm strainer. The remaining splenocytes were pelleted for further procedures. For KM031 and KM032, axillary, inguinal and mesenteric lymph nodes were also removed and placed in sterile 1×PBS on ice until further processing. The lymph nodes were processed separately from splenocytes. Lymph node cells were prepared as above, but did not undergo red blood cell lysis. The remaining lymph node cells were pelleted for further procedures.

h) Hybridoma Fusion

Spleen and lymph node cells were pooled from KM031 and also from KM032 and subjected to a negative selection method using the MACS® Separation system. Briefly, where lymph nodes were used those cells were pooled with the splenocytes from the corresponding mice after red blood cell lysis and total cell number determined. Cells were resuspended in 100 µL 3% FBS/PBS buffer per $10^7$ cells, before adding 10 µL of Pan B Cell Biotin-Antibody Cocktail (Cat #130-095-813) per 107 total cells and 10 µL of anti-IgD-Biotin antibody (Cat #130-096-979) and incubated for 10 minutes at 4° C. 2 mL FBS/PBS buffer was added and the cells were spun down at 700 g for 10 minutes. The supernatant was aspirated completely and 100 uL fresh buffer was added, then 30 uL Anti-Biotin MicroBeads (Cat #130-047-302) was added per $10^7$ cells along with 7 µL Anti-Mouse IgM MicroBeads (Miltenyi Biotec). The cells were incubated for 15 minutes in the refrigerator. The cells/MicroBeads mixture was then applied to a pre-wetted LD column (Miltenyi Biotec) placed in a magnetic MACS Separator and washed with 3% FBS/PBS buffer. The unlabelled cells that flowed through the column were collected in 3% FBS/PBS buffer.

KM033 cells were subjected to a positive selection method using the MACS® Separation system. After red blood cell lysis, splenocytes were resuspended in 80 µL 3% FBS/PBS buffer per $10^7$ cells, before adding anti-mouse IgG1 (Cat #130-047-101) plus anti-mouse IgG2a+b Micro-Beads (Cat #130-047-201) and incubated for 15 minutes at 4° C. The cell/MicroBead mixture was then applied to a pre-wetted LS column (Miltenyi Biotec) placed in a magnetic MACS Separator and washed with 3% FBS/PBS buffer. IgG positive cells were collected in the labelled, column-bound fraction in 3% FBS/PBS buffer.

Enriched B-cells were treated with CpG (Hokkaido System Science) overnight (final concentration 25 µM) and the following day washed once in BSA fusion buffer (0.3 M D-Sorbitol, 0.11 mM calcium acetate hydrate, 0.5 mM magnesium acetate tetrahydrate and 0.1% BSA (v/w), adjusted to pH 7.2). Washed cells were resuspended in 200 µL BSA fusion buffer and cell count determined. SP2/0 cells were treated in the same way, but washed twice instead of once with BSA fusion buffer. B-cells fused at a ratio of 3:1 with SP2/0 myeloma cells by electrofusion using a BTX ECM 2001 Electro Cell Manipulator (Harvard Apparatus). Each fusion was left overnight in recovery medium (Dulbecco's Modified Eagle's Medium (high glucose, no phenol red) supplemented with OPI (Sigma), 1×L-Glutamax (Gibco), 20% FBS (Gibco, batch-tested for hybridoma) and 0.05 mM 2-mercaptoethanol), then resuspended in 1 part recovery medium and 9 parts semi-solid medium (ClonaCell-HY Hybridoma Selection Medium D, Stemcell Technologies) and seeded onto 10 cm petri dishes. Visible colonies were picked 12 days later into 96-well plates and cultured for another 2 to 3 days prior to screening.

Example 2—Hybridoma Supernatant Screening

After generation of hybridoma clones, the hybridoma supernatant was assessed in a sequential primary and secondary screen and appropriate hybridoma clones selected based on criteria of antibody binding to human PD-L1 and receptor neutralization activity. In the screening cascades described, 9317 hybridoma clones were tested and 120 identified as primary hits. Thereafter, 36 hybridoma clones were confirmed by using secondary screening criteria (see details in Materials and Methods and Table 1). Among the clones identified by secondary screen, four clones were selected by the inventors to be part of the antibody shortlist, dependent upon desired selection criteria (see details in Example 3).

Materials and Methods a) Primary Screen—Binding to Cell-Expressed Human PD-L1

Supernatants collected from hybridoma cells were screened for the ability of secreted antibodies to bind to hPD-L1 expressed on the surface of CHO-S cells. To determine CHO-S hPD-L1 binding, cells were plated in black-walled, clear-bottom tissue culture treated 384-well plates (Costar) at $1\times10^4$/well in 80 µL F12 media (Gibco) supplemented with 10% FBS (Gibco) and cultured overnight at 37° C., 5% $CO_2$. Culture media was removed from 384-well assay plates. At least 5 µL of hybridoma supernatant or 5 µL MIH1 at 2 µg/mL in hybridoma maintaining media (HMM) or isotype IgG1 control antibody (referred to in some instances as Cm7, Sigma M9269, at a final concentration of 1 µg/mL) diluted in HMM were added to each well. HMM was made up of Advanced DMEM (Gibco) supplemented with 1× Glutamax (Gibco), 20% v/v FBS (Gibco), 0.05 mM β-Mercaptoethanol, 1×HT supplement (Gibco), and 1× penicillin/streptomycin (Gibco). 45 µL FACS buffer containing 500 ng/mL IRDye 800CW anti-Mouse Ab (LICOR) and 0.2 µM DRAQ5 (Biostatus) was added to each well. DRAQ5 was not added to background wells. Plates were incubated for 1 hour at 4° C. Supernatant was aspirated and 25 µL 4% v/v paraformaldehyde added and plates were incubated for 15 minutes at room temperature. Plates were washed twice with 100 µL PBS and then the wash buffer was completely removed. Fluorescence intensity was read by scanning plates using an Odyssey Infrared Imaging System (LI-COR®). Anti-mouse binding (800 nm channel) was normalised to cell number (700 nm channel) according to the LI-COR® recommended algorithm. Percent effect was calculated as detailed below (Equation 1). Total binding was defined using reference antibody at a final assay concentration of 0.2 µg/mL. Non-specific binding was defined using mouse IgG1 isotype control (Sigma) at a final assay concentration of 0.2 µg/mL. Criteria for hit selection were based on assay signal and visual inspection of scanned plates.

Calculation of Percentage Effect from Primary Screen (LI-COR) and HTRF

Using 800% Resp values (LI-COR) or 665/620 nm ratio (see Equation 2) (HTRF)

$$\text{Percent effect} = \frac{(\text{sample well} - \text{non-specific binding})}{(\text{total binding} - \text{non-specific binding})} \times 100 \quad \text{Equation 1}$$

Non-specific binding = values from wells containing isotype control mouse IgG1

Total Binding = values from wells containing reference antibody b) Primary Screen: Binding to Recombinant Human PD-L1

In parallel to screening for binding to CHO-S expressed PD-L1, supernatants collected from hybridoma wells were screened for the ability of secreted antibodies to bind to hPD-L1 expressed as a recombinant protein (produced in-house). Binding of secreted antibodies to recombinant PD-L1 were identified by HTRF® (Homogeneous Time-Resolved Fluorescence, Cisbio) assay format using biotinylated hPD-L1. 10 μL hybridoma supernatant was transferred to a white 384 well, low-volume, non-binding surface polystyrene plate (Greiner). 5 μL 230 nM biotinylated hPD-L1 his diluted in HTRF assay buffer (PBS (Sigma)+ 0.53 M KF (Sigma)+0.1% w/v BSA (Sigma)) was pre-incubated with 10 μL hybridoma supernatant or 10 μL reference antibody diluted to 3.3 nM working concentration for 1 hour at room temperature. For negative control wells, 10 μL HMM was added. Streptavidin D2 (Cisbio), and goat anti-mouse IgG (Southern Biotech) labelled with Europium cryptate (Cisbio) were both diluted 1/100 in HTRF assay buffer, and 5 μL of this mixture added to all wells. The plate was left to incubate in the dark for 2 hours prior to reading time resolved fluorescence at 620 nm and 665 nm emission wavelengths using an EnVision plate reader (Perkin Elmer). More details of the HTRF® assay technology can be found in Mathis (1995) Clinical Chemistry 41(9), 1391-1397.

Data were analysed by calculating 665/620 ratio and percent effect for each sample according to Equation 2 and Equation 1 respectively.

$$665/620 \text{ ratio} = \frac{(\text{sample } 665/620 \text{ nm value}) \times 10000}{}$$

Equation 2: Calculation of 665/620 ratio

In general, criteria for hit selection were based on greater than or equal to 10 percent effect.

In some instances, hit selection was based on greater than or equal to 20 percent effect.

Progression to secondary screen was based on a combination of data from recombinant PD-L1 binding hits and binding to human PD-L1 expressed on CHO cells.

c) Secondary Screen: Binding to Cell Expressed Recombinant Human PD-L1 or Natively Expressed hPD-L1 and Binding Affinity To determine whether wells selected using the primary screen selection criteria had the required characteristics set by the inventors, a number of assays were performed. Hybridoma clones selected as hits from primary screening were cultured for 3 days and the supernatants collected from hybridoma cells were tested to assess whether the secreted antibodies that bind to in some cases CHO-S expressed hPD-L1, or in some cases ES2 cells. In addition, the ability to neutralise recombinant hPD-1 Fc, binding to CHO-S hPD-L1 or ES2 cells was also assessed. Binding of antibodies to human PD-L1 by SPR was also tested.

d) Binding to Cell Expressed hPD-L1 and Neutralisation and hPD-L1 Binding to PD-1

Binding of hybridoma supernatants was tested for ability to bind to either CHO-S cells expressing hPD-L1 or ES2 cells. CHO-S cells expressing hPD-L1 (generated in-house), or ES2 cells (ATCC CRL-1978) natively expressing hPD-L1 were diluted in FACS buffer and were distributed to a 96-well, V-bottom plate (Greiner) at a density of 0.5 to $1 \times 10^5$ cells per well. Cells were washed with 150 μL PBS and centrifuged at 300 g for 3 minutes. Supernatant was aspirated and 150 μL PBS added. This wash step was repeated.

50 μL hybridoma supernatant or purified hybridoma material was added to the washed cells, to which 500 ng/mL human PD-1 Fc (in-house, Seq ID No:6) was added. Reference antibody was added to medium at 2 μg/mL. Where purified material was used, titrations were prepared from a top concentration of 600 nM before addition to cells. When supernatants were used, neat supernatant, and three serial two-fold dilutions were added to cells. Cells were incubated at 4° C. for 30 minutes. Cells were washed twice with 150 μL FACS buffer, centrifuging at 300 g for 3 minutes after each wash step and aspirating supernatant.

To detect antibody and receptor binding, 50 μL goat anti-human IgG-PE (Jackson ImmunoResearch) and APC anti-mouse IgG (Jackson ImmunoResearch) diluted 1/500 in FACS buffer was added to the cells. Cells were incubated for 30 minutes at 4° C. in the dark. Cells were washed twice as above and resuspended in FACS buffer for analysis. PE and APC signal intensity (geometric mean) was measured by flow cytometry using a BD FACS Array instrument. Data was plotted as geometric mean values without further calculation.

e) Determination of Affinity by Surface Plasmon Resonance

Label-free surface plasmon resonance (SPR) analysis was carried out on the ProteOn XPR36 (BioRad) array SPR machine. An anti-mouse IgG capture surface was created on a GLC biosensor chip using amine coupling of an anti-mouse IgG from GE Healthcare. Test antibodies were captured on this surface and human PD-L1 (in-house) was used as the analyte at 256 nM, 64 nM, 16 nM, 4 nM and 1 nM. The assay was carried out at 25° C. using HBS-EP (Teknova H8022). Buffer alone was used to reference the binding sensorgrams. The data was analysed using the 1:1 model inherent to the ProteOn XPR36 analysis software. In some instances, hybridoma supernatants were used as the source of antibody; in other instances, antibody was purified from hybridoma supernatant prior to analysis (see below). In some instances, a Protein A/G capture surface was used. This was created on a GLM biosensor chip using amine coupling of Protein A/G from Biorbyt.

f) Purification of Antibodies from Hybridoma Supernatant

Protein G resin in a gravity-flow column was first washed with water, then 50 mM sodium hydroxide or IgG Elute (Pierce) and was then equilibrated with tissue culture grade PBS. Clarified hybridoma supernatant containing 10% v/v 10× tissue culture grade PBS was applied several times to the equilibrated protein G column. Resin was washed with tissue culture grade PBS to remove unbound material. Antibody was then eluted with IgG Elute (Pierce) and the eluted fraction was then neutralized with 100 mM final TRIS, at pH 8.0. The eluted fraction was then concentrated down to <1.5 mL by centrifugation in a 10 kDa cut-off centrifugal filter unit. Tissue culture grade PBS was then added and the sample was concentrated down again to <1.5 mL. Protein concentration was quantified at $OD_{280}$ using the molar extinction coefficient inherent to the Nanodrop for IgG. Finally, sample was analysed on a SDS-PAGE to assess purity.

TABLE 1

Summary of hybridoma clone screening

| Experiment ID | Number of hybridoma screened | Number of Primary hits cherry picked | Number of secondary hits confirmed | Number of Lead Candidate mAbs |
|---|---|---|---|---|
| KM031 | 1872 | 41 | 4 | 0 |
| KM032 | 115 | 14 | 6 | 1 |
| KM033 | 7330 | 66 | 26 | 1 |

Example 3—Antibody Shortlist Selection Criteria

Binding to hPD-L1 natively expressed on ES2 cells, and neutralisation of recombinant human PD-1 binding to ES2 cells were used as criteria for secondary screen hit selection. Hits to progress to purification and further characterisation were determined by a combination of high affinity for human PD-L1 and neutralisation capacity.

After the selection and characterization of shortlisted antibodies, their fully-human variable domains were recovered using RT-PCR using a mixture of forward and reverse primers. Antibodies were reformatted into a human IgG1 backbone and expressed using a transient expression system in CHO-S cells.

Materials and Methods a) RNA Isolation from Hybridoma Cells

Total RNA was extracted from hybridoma cells using TRIzol™ Reagent (Invitrogen). The quantity and quality of the isolated RNA was analysed spectrophotometrically.

b) Antibody Variable Domain Recovery by RT-PCR

Selected clones were used to prepare total RNA, which was used in an RT-PCR reaction to recover the heavy and light chain V-regions. Murine IgG-specific reverse primers and human Ig-leader sequence-specific forward primer sets were used for the heavy chains. Murine kappa constant region specific reverse primers and human kappa-leader sequence specific forward primer sets were used for the kappa light chains. The RT-PCR products were separated by agarose gel electrophoresis with the DNA of the predicted size being gel purified and sequenced in the forward and reverse directions. Alternatively, the RT-PCR products were subcloned into a cloning vector and DNA of individual colonies submitted for sequencing.

Example 4—Selection of Final Lead Panel

Recombinantly expressed antibodies were analysed by SPR to confirm binding to cynomolgus monkey PD-L1, as well as human PD-L1. Antibodies were also tested in a dendritic cell-T-cell mixed lymphocyte reaction (MLR) for ability to enhance IFNγ production (FIG. 1). Antibodies with consistent immune-stimulatory effects in the MLR, and binding to both human and cynomolgus PD-L1 were selected as the final lead panel—these were designated as clone 84G09 and clone 1D05. Data in FIG. 1 is from a single experiment. A further five experiments were conducted and showed similar results (84G09 showed activity in 3 out of 5 experiments, 1D05 showed activity in 3 out of 4 experiments, 1A01 showed activity is 1 out of 3 experiments and 8B09 showed activity in 0 out of 3 experiments). One further experiment failed (including positive control).

Materials and Methods a) Surface Plasmon Resonance for Analysis of Antibodies with Human Constant Region Label-free surface plasmon resonance (SPR) analysis was carried out on the ProteOn XPR36 (BioRad) array SPR machine. An anti-human IgG capture surface was created on a GLC biosensor chip using a combination of anti-human Fc antibodies (Jackson Labs 09-005-008, 109-006-008 and 309-006-008) by amine coupling. Test antibodies were captured on this surface and human PD-L1-his and cynomolgus monkey PD-L1-FLAG (in-house, Seq ID No: 5) was used as the analyte at 128 nM, 32 nM, 8 nM, 2 nM, 0.5 nM and 0 nM. The data was analysed using the 1:1 model inherent to the ProteOn XPR36 analysis software.

b) Dendritic Cell—T-Cell MLR (Mixed Lymphocyte Reaction)

Dendritic cells were generated from monocytic precursors. Monocytic precursors were isolated from peripheral blood mononuclear cells (PBMCs) isolated using Ficoll-Paque plus (GE Healthcare) density gradient centrifugation from leukoreduction system chambers (NHSBT). Monocytes were isolated from PBMCs using negative selection magnetic separation beads (Miltenyi Biotec). Monocytes were plated in 96-well, flat-bottom TC plates at $5 \times 10^4$/well and $1 \times 10^4$/well and cultured with cytokines GM-CSF and IL-4 (both Peprotech) at 100 ng/mL for 7 days in culture media (Advanced RPMI (Gibco) supplemented with 10% v/v FBS and 2 nM glutamine (culture medium).

After 7 days, T-cells were purified from allogeneic PBMC using negative selection magnetic separation beads (Miltenyi). After purification, the isolation buffer was removed by centrifugation and aspiration. The cells were resuspended at $1 \times 10^6$ cells/mL in culture medium, and 100 μL of T-cells were added to all wells with the exception of the DC-only wells. An additional 100 μL of culture medium was added to the DC-only and T-cell-only wells. Serial three-fold dilutions of antibodies were prepared in culture medium (top concentration 60 nM final). 10 μL of each dilution was added to cells.

The cells were incubated for five days at 37° C. After this period IFN-γ was measured by Duoset ELISA (R&D Systems) according to manufacturer's instructions.

Example 5—in Depth Characterisation of Lead Antibodies

Lead antibodies 84G09 and 1D05 were subjected to in-depth characterisation, including SPR at 37° C., full titrations of antibodies in neutralisation assays, and confirmation of binding to PD-L1 but not PD-L2. Antibodies were also expressed with a human IgG4(PE) constant region (Seq ID No:199) for analysis by mixed lymphocyte reaction. Lead antibodies retain sub-nanomolar affinity at 37° C., and show potent neutralisation of PD-L1 binding to both PD-1 and CD80. Antibodies do not cross-react with PD-L2, bind natively expressed PD-L1 on dendritic cells, and are potent stimulators of IFNγ production in an MLR.

a) Human PD-L1/PD-1 Neutralisation Assay (ELISA)

Figure 2:
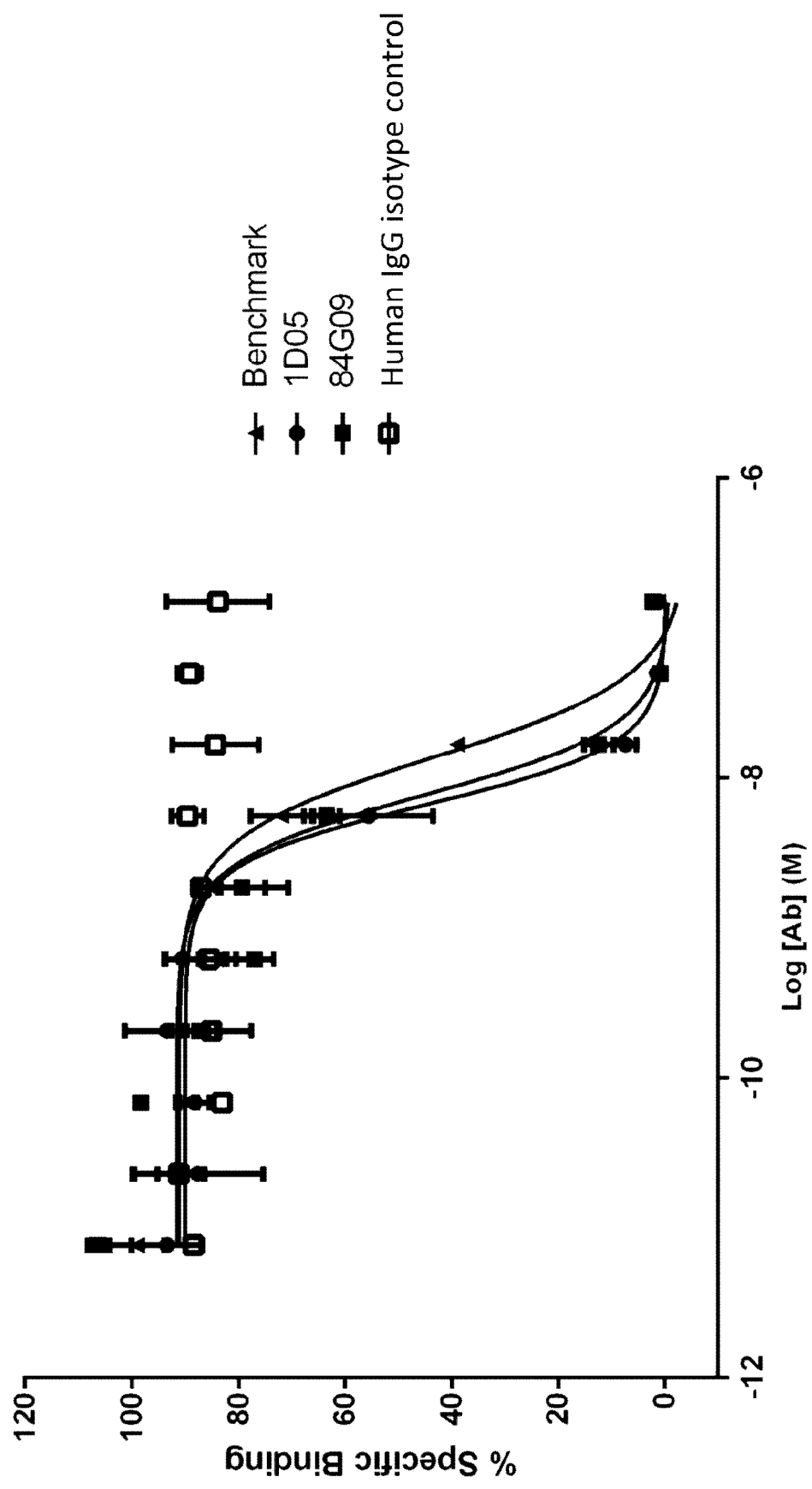
FIG. 2: PD-L1 direct neutralisation ELISA with PD-1 receptor. Neutralisation profiles of 1D05 and 84G09 compared to a benchmark anti-PD-L1 antibody and isotype control. Data representative of three independent experiments

PD-1 Fc (in house, Seq ID No:6) diluted to 1 μg/mL was adsorbed to 96-well, low auto-fluorescent, high protein binding plates (Costar) overnight at 4° C. Excess protein was removed by washing with PBS-Tween (0.1% v/v) and the wells were blocked with 1% w/v bovine serum albumin (BSA, Sigma) in PBS for 1 hour at room temperature, after which plates were washed as described previously. 30 μL titration (1/3 dilution) of antibody was added to a 96-well non-binding plate diluted in ELISA assay buffer (PBS+0.1% BSA). 30 μL biotinylated PD-L1 his (in-house, Seq ID No:3) at 50 nM working concentration (25 nM final assay concentration [FAC]) was added to the plate excluding control wells where 30 μL ELISA assay buffer was added. The plate was incubated for 30 minutes before transferring 50 μL to the coated plates. The coated plates were incubated for 1 hour at room temperature. Excess protein was removed by washing with PBS-Tween (0.1% v/v). PD-L1 binding was detected using streptavidin labelled Europium (Perkin Elmer) diluted 1/1000 in DELFIA assay buffer (Perkin Elmer). Plates were washed with TBS (Tris buffered saline)-Tween (0.1% v/v) and 50 μL/well of DELFIA Enhancement solution (Perkin Elmer) was added to the plate. Time-resolved fluorescence was measured at 615 nm on an Envision plate reader (PerkinElmer). Percentage of specific binding was calculated using Equation 3. IC50 values were determined using GraphPad Prism software by curve fitting using a four-parameter logistic equation (Equation 4). Results are shown in FIG. 2 and summarised in Table 2.

Percentage of receptor binding (*ELISA*)

Based on Fluorescence at 615 nm $$\% \text{ of specific binding} = \frac{\text{sample value} - \text{non-specific binding}}{\text{total binding} - \text{non-specific binding}} \times 100 \quad \text{Equation 3}$$

Total binding = biotinylated *PD-L1* (no antibody)
Non-specific binding = no biotinylated *PD-L1*

$$Y = \text{Bottom} + (\text{Top} - \text{Bottom})/(1 + 10^{\wedge}((\text{Log}IC50 - X) * HillSlope)) \quad \text{Equation 4}$$

$X$ = logarithm of concentration.
$Y$ = specific binding (Equation 3)
Top and Bottom = Plateaus in same units as $Y$ (specific binding)

Log $IC_{50}$ in same units as X. Y starts at Bottom and goes to Top with a sigmoid shape. Specific binding decreases as X increases.

c) CHO Human PD-L1/PD-1 or CD80 Neutralisation Assay (Flow Cytometry)

Figure 3:
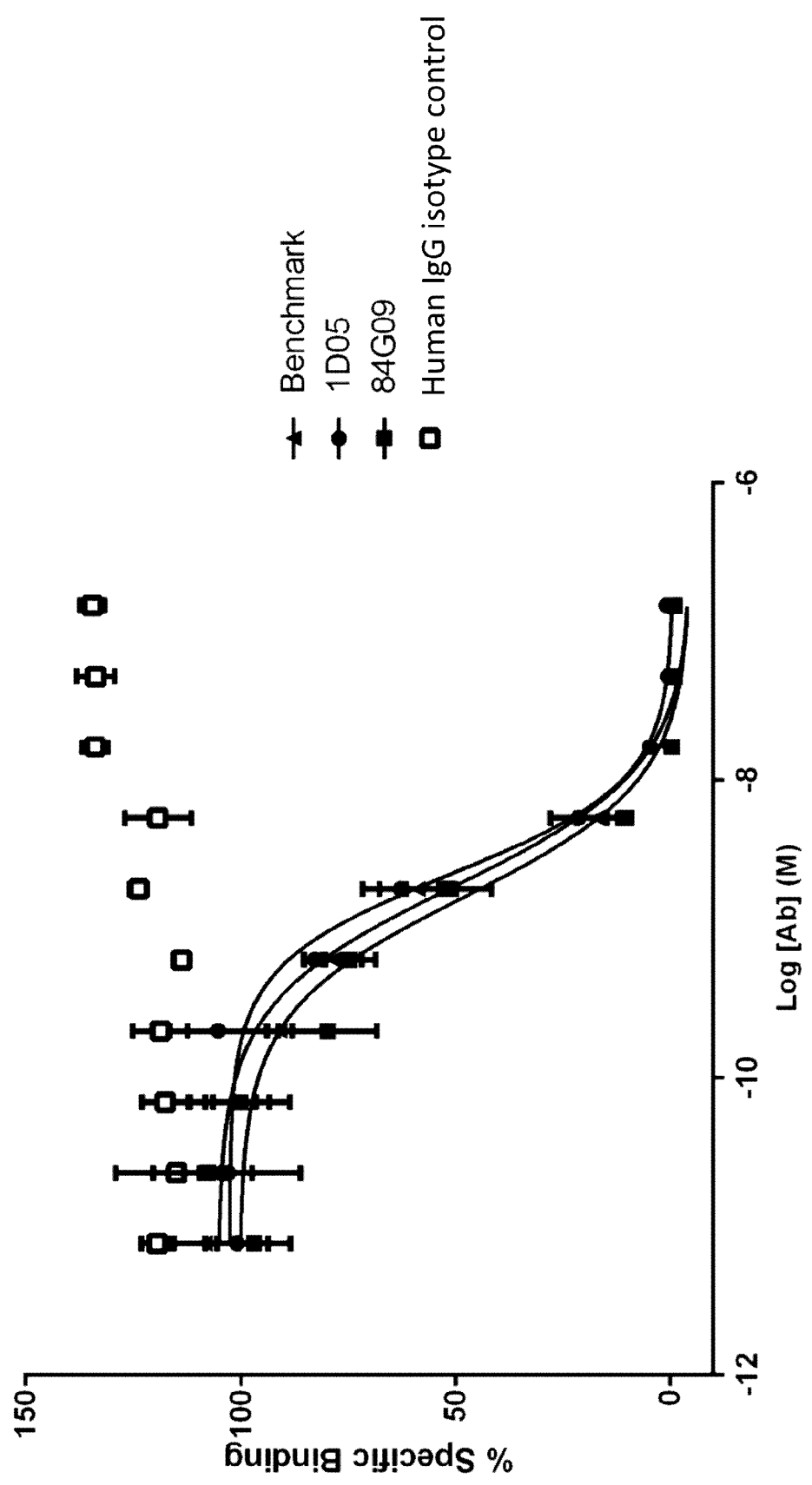
FIG. 3: Human PD-L1 CHO-S FACS neutralisation with PD-1 receptor. Neutralisation profiles of 1D05 and 84G09 compared to a benchmark anti-PD-L1 antibody and isotype control. Data representative of three independent experiments
Figure 4:
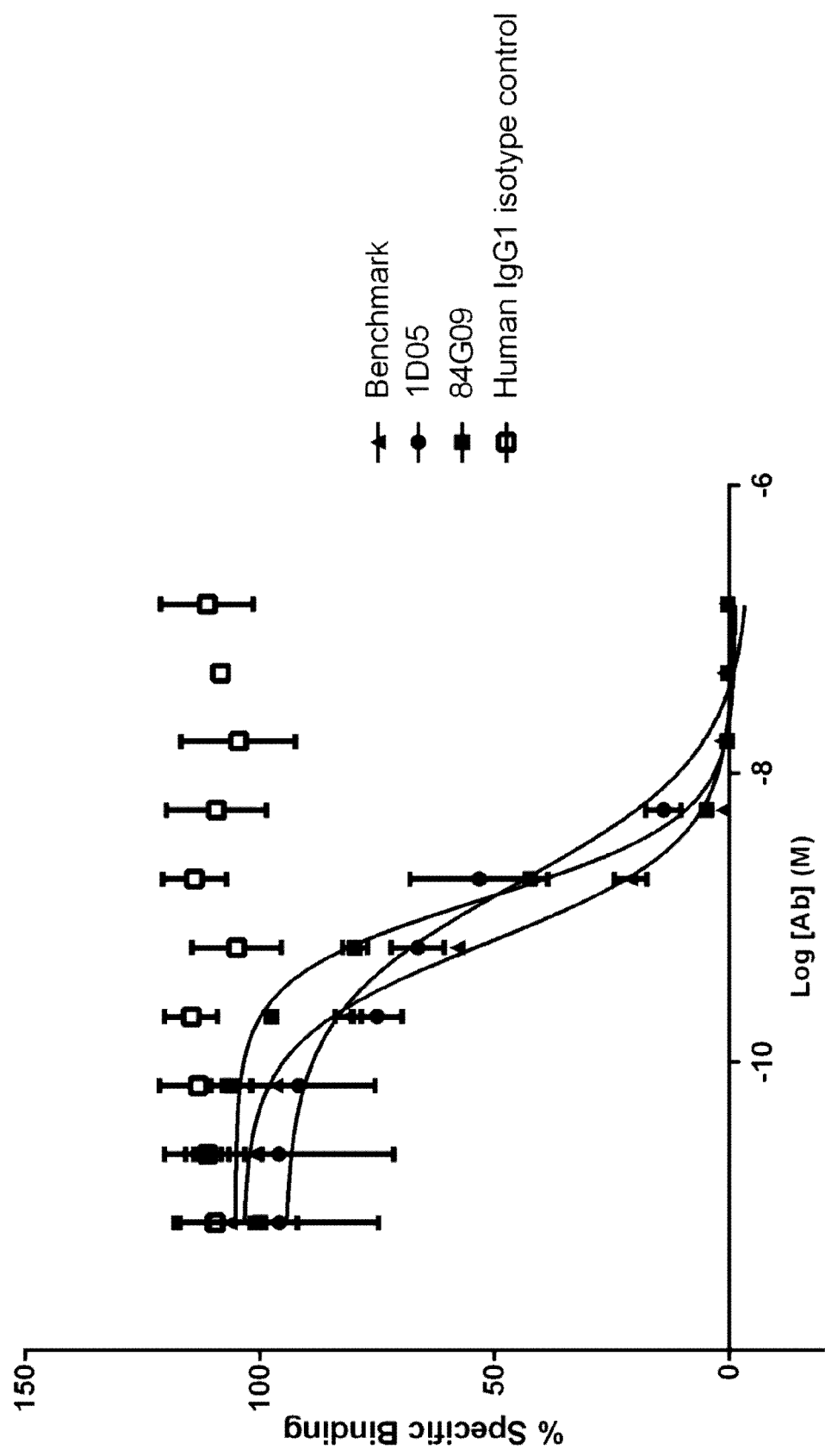
FIG. 4: Human PD-L1 CHO FACS neutralisation with CD80 receptor. Neutralisation profiles of the 1D05 and 84G09 compared to the benchmark anti-PD-L1 antibody and isotype control. Data representative of three independent experiments

CHO-S cells untransfected (referred to as WT) or transfected with hPD-L1 were diluted in FACS buffer and were distributed to a 96-well V-bottom plate (Greiner) at a density of $1 \times 10^5$ cells per well in 50 μL. Biotinylated human PD-1-Fc (in-house expressed, Seq ID No:6) or CD80-Fc (R&D Systems) were prepared as a titration from 1 μM final assay concentration (FAC), 1/2 dilution series in FACS buffer. Antibody titrations were prepared from 300 nM working concentration, 150 nM FAC, as a 1/3 dilution series in FACS buffer. Biotinylated PD-1 or CD80 were diluted in FACS buffer to 60 nM working concentration, 30 nM FAC. Plates were centrifuged at 300×g for 3 minutes to supernatant aspirated. 25 μL ligand and 25 μL antibody solution (or 50 μL of ligand titration) were added to cells and incubated at 4° C. for 1 hour. Cells were washed with 150 μL of PBS and centrifuged at 300 g for 3 minutes. Supernatant was aspirated and 150 μL PBS added. This wash step was repeated. Presence of bound CD80 or PD-1 was detected by addition of 50 μL of streptavidin-AlexaFluor 647 (Jackson ImmunoResearch) diluted 1/500 in FACS buffer. Cells were incubated 30 minutes at 4° C. in the dark. Cells were washed as described above. To fix cells, 100 μL 2% v/v paraformaldehyde was added and cells incubated for 30 minutes at 4° C., cells were pelleted by centrifugation at 300×g and the plates resuspended in 100 μL FACS buffer. AlexaFluor 647 signal intensity (geometric mean) was measured by flow cytometry using a BD FACS Array instrument. Results are shown in FIGS. 3 and 4 and summarised in Table 2.

Percentage of receptor binding (flow cytometry)

Based on geometric mean fluorescence $$\% \text{ of specific binding} = \frac{\text{sample value} - \text{non-specific binding}}{\text{total binding} - \text{non-specific binding}} \times 100 \quad \text{Equation 5}$$

Total binding biotinylated *PD*-1 or *CD*80 only (no antibody)
Non-specific binding = no ligand streptavidin *AlexaFluor* 647 only

TABLE 2

Summary of lead antibody binding and neutralisation of PD-L1 binding to PD-1 or CD80

| | | | Receptor Neutralisation (mean of n = 3) | | |
| --- | --- | --- | --- | --- | --- |
| Clone ID | Human PD-L1 (nM at 37° C.) | Cyno PD-L1 (nM at 37° C.) | PD-L1/PD-1 neutralisation (FACS) $IC_{50}$ (nM) | PD-L1/CD80 neutralisation (FACS) $IC_{50}$ (nM) | PD-L1/PD-1 neutralisation (ELISA) $IC_{50}$ (nM) |
| 1D05 | 0.42 | 0.43 | 2.21 | 1.18 | 5.21 |
| | $K_{on}$ = 1.85 μM | $K_{on}$ = 1.89 μM | | | |
| | $K_{off}$ = 0.779 mM | $K_{off}$ = 0.813 mM | | | |
| 84G09 | 0.43 | 0.52 | 1.82 | 1.60 | 7.90 |
| | $K_{on}$ = 2.43 μM | $K_{on}$ = 2.61 μM | | | |
| | $K_{off}$ = 1.05 mM | $K_{off}$ = 1.35 mM | | | |
| Benchmark | 0.25 | 4.79 | 1.85 | 1.42 | 14.1 | d) PD-L1/PD-L2 Binding

Figure 5A:
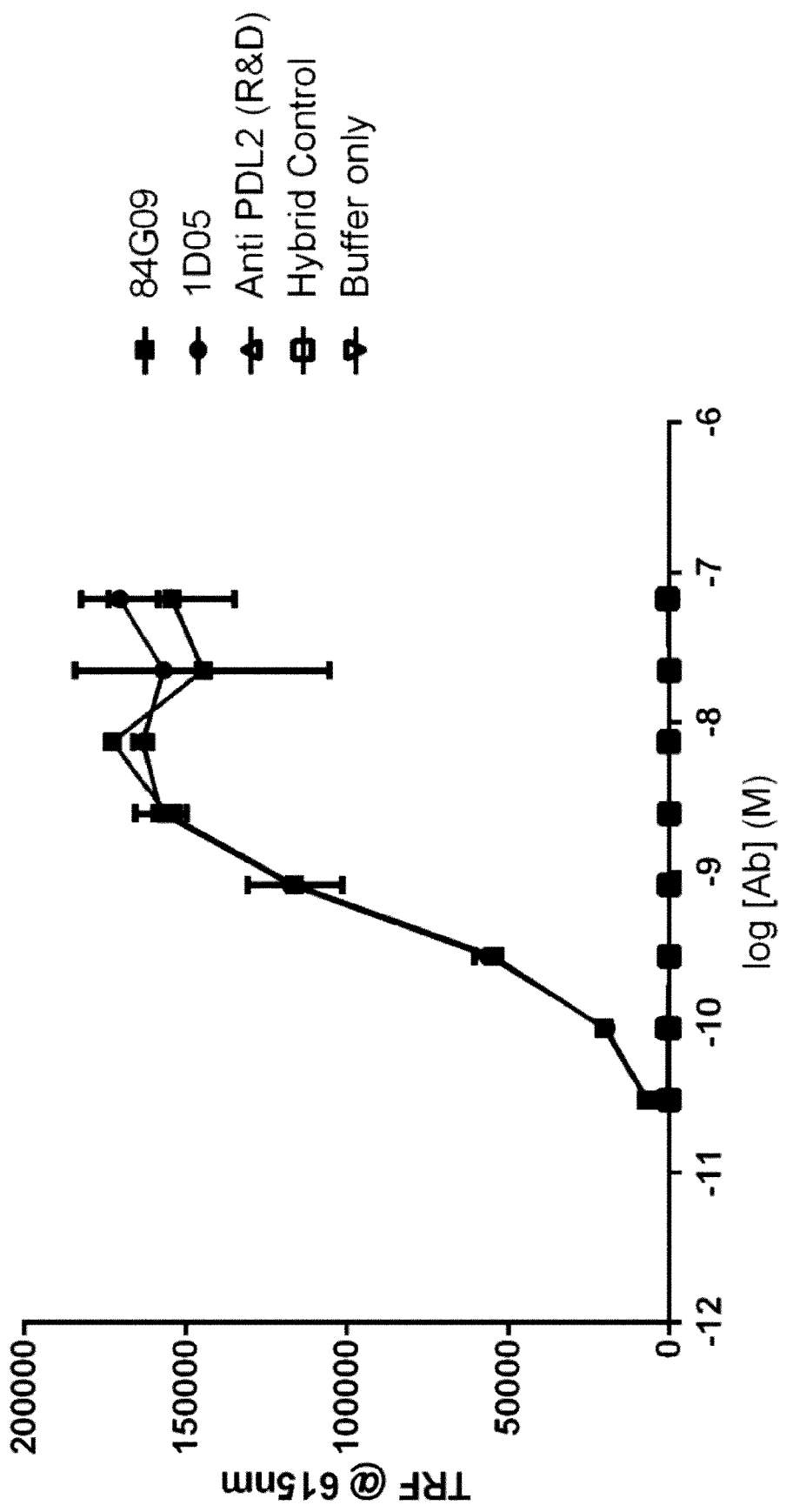
FIG. 5: Binding of lead antibodies to PD-L1 but not PD-L2. Lead antibodies bind to plate bound PD-L1 (FIG. 5a) but not PD-L2 (FIG. 5b). An anti-PD-L2 antibody was used as a control. Data are expressed as time resolved fluorescence units at 615 nm. Data representative of two independent experiments
Figure 5B:
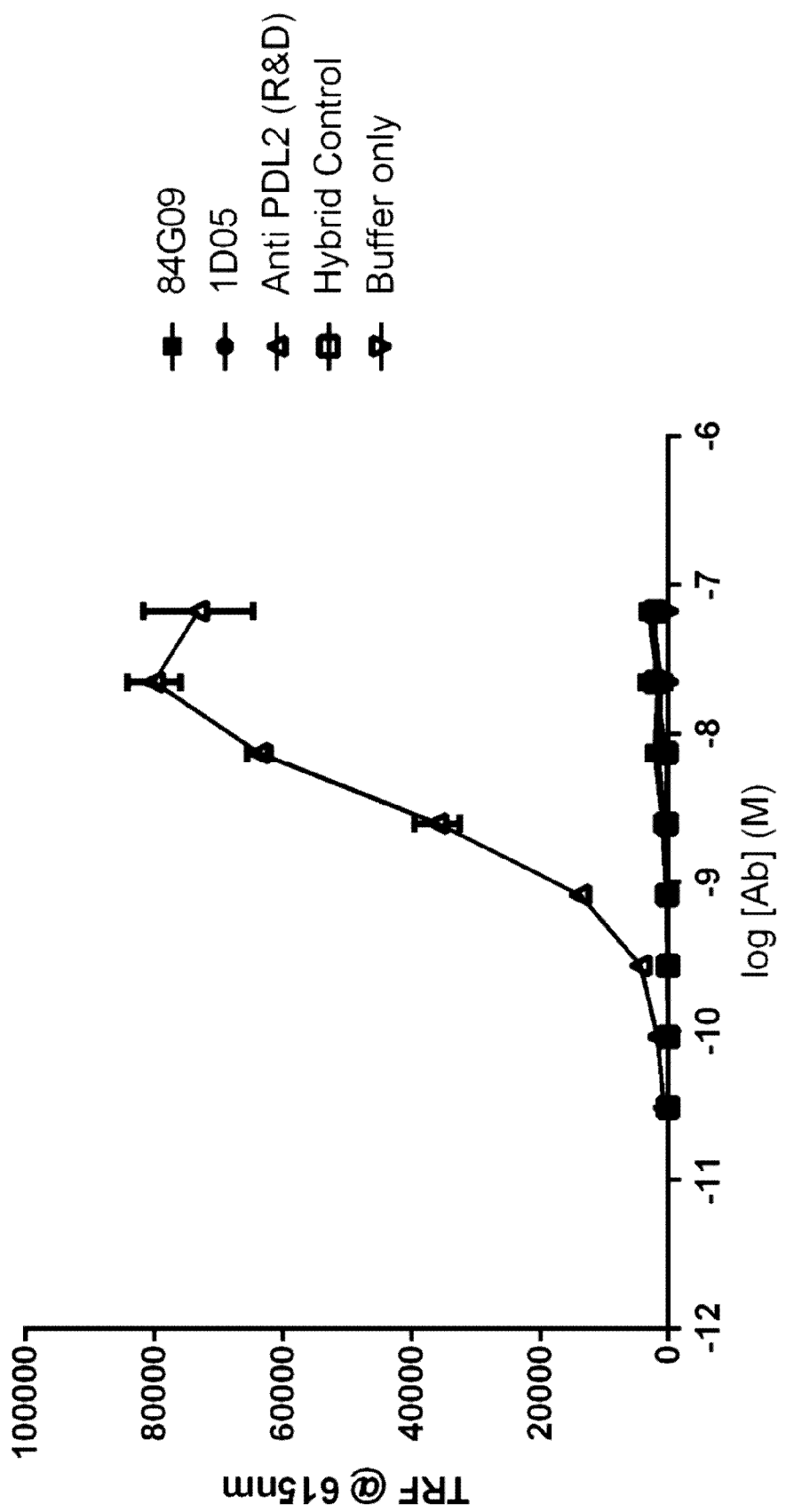

PD-L1-Fc (R&D Systems) and PD-L2-Fc (R&D Systems) were diluted to 2 μg/mL and separately adsorbed to 96-well, high protein binding plates (Greiner) overnight at 4° C., 50 μL/well. Excess protein was removed by washing with PBS-Tween (0.1% v/v) and the wells were blocked with 250 μL/well Pierce Protein Free Blocking Buffer (Thermo, 37572) for 1 hour, after which plates were washed as described previously. Biotinylated anti-PD-L1 antibodies (in-house) or anti-PD-L2 control antibody (R&D Systems) were diluted in blocking buffer and three-fold serial dilutions performed from 10 μg/mL. 100 μL each antibody dilution was added to the plates in duplicate and incubated for 1 hour at room temperature, before washing as stated above. Antibody binding was detected using streptavidin labelled Europium (Perkin Elmer) diluted 1/1000 in DELFIA Assay buffer (Perkin Elmer). Plates were washed with TBS (Tris buffered saline)-Tween (0.1% v/v) and 50 μL/well of DELFIA Enhancement solution (Perkin Elmer) was added to the plate. Time-resolved fluorescence was measured at 615 nm on an Envision plate reader (PerkinElmer). Results are shown in FIG. 5.

e) SPR Analysis

Label-free surface plasmon resonance (SPR) analysis was performed as per Example 4, except the assay was performed at 37° C. Additionally, due to artefacts of running the assay at 37° C., the best referencing of the binding sensorgrams was found to be using a sensorgrams from a negative control antibody using the same concentrations of human PD-L1. Results are shown in Table 2.

f) Mixed Lymphocyte Reaction

Figure 6:
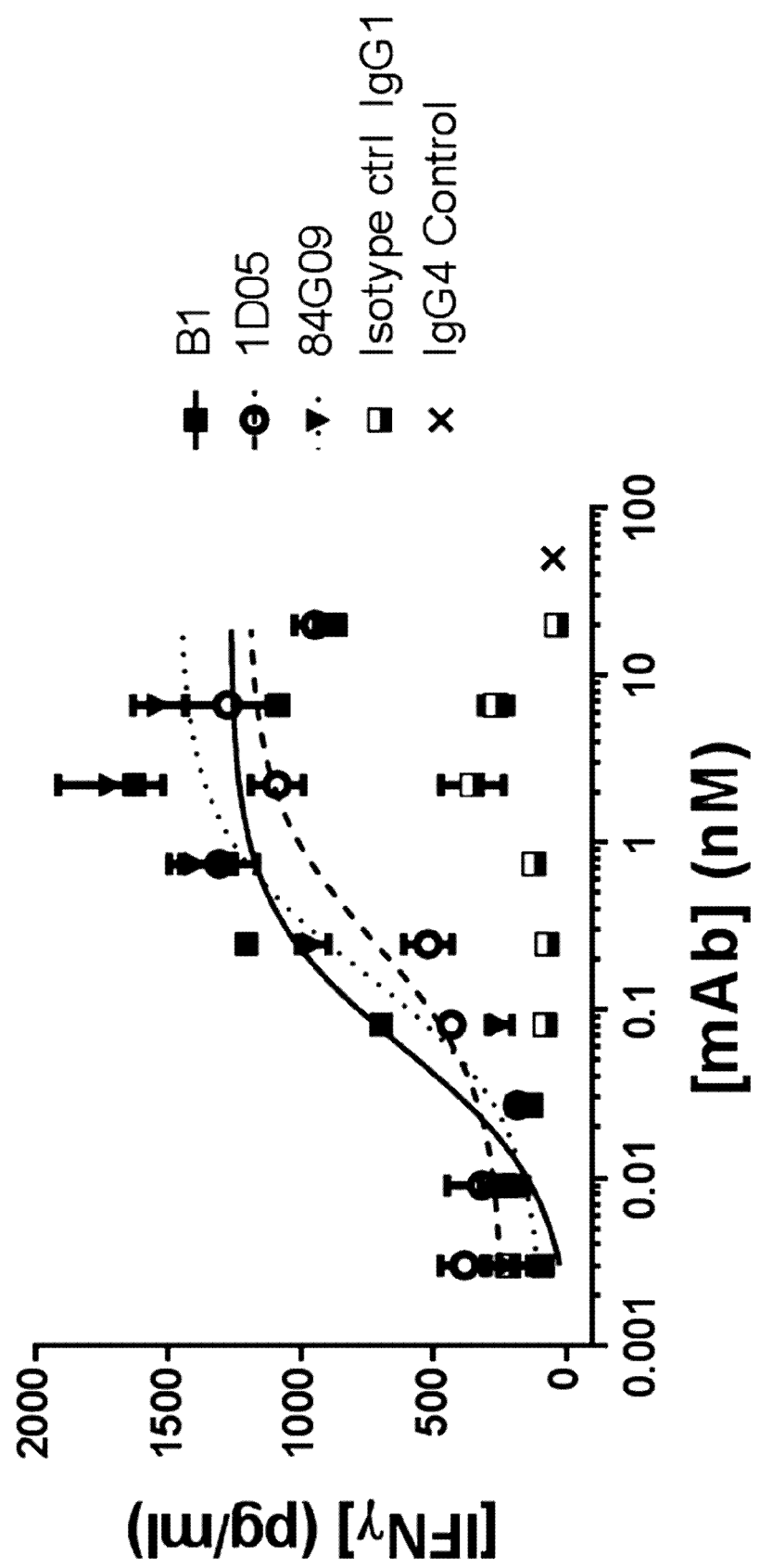
FIG. 6: Lead antibodies induce IFNγ production in a Dendritic Cell-T-cell mixed lymphocyte reaction. Immature dendritic cells were co-cultured with allogeneic CD4+ T-cells in the presence of antibodies for 5 days. IFNγ was measured in supernatants by ELISA. Data are representative of three independent experiments. B1 refers to a benchmark antibody

Expanded CD4$^+$ T-cells were thawed and rested in AIM V© medium (Gibco) at 37° C., 5% C02 overnight prior to the assay day. Serial dilutions of anti-human PD-L1 mAbs were prepared in the AIM medium at 4× final concentration. 50 μL of diluted mAbs was added to 96-well, U-bottom plates. 1×10$^4$ immature dendritic cells (iDC) in 50 μL AIM medium and 1×10$^5$ expanded CD4$^+$ T-cells (expanded using Dynabeads Human T-Activator CD3/CD28 by Life Technologies (Invitrogen/Applied Biosystems; Cat No: 11131D), according to manufacturer's instructions) in 100 μL AIM medium were added to the antibody dilutions in each well. Control wells include: CD4$^+$ T-cells alone, iDC alone, CD4$^+$ T-cell and iDC with or without IgG isotype control antibodies in 200 μL AIM medium. Reaction plates were incubated for 5 days in a humidified incubator (37° C. in 5% CO$_2$). At the end of the assay, the plate was spun down (528×g for 3 minutes) and 100 μL of supernatant was collected from the wells by gentle pipetting. Supernatants were analysed using human IFNγ Quantikine ELISA kit (R&D Systems) according to manufacturer's instructions. Results are shown in FIG. 6.

g) Sequencing and Characterisation of Gene Segment Usage of 1D05 and 84G09

Antibodies were sequenced by Source Bioscience, and V-genes were compared to germline sequences.

h) Binding of Lead Antibodies to Natively Expressed PD-L1

Figure 7A:
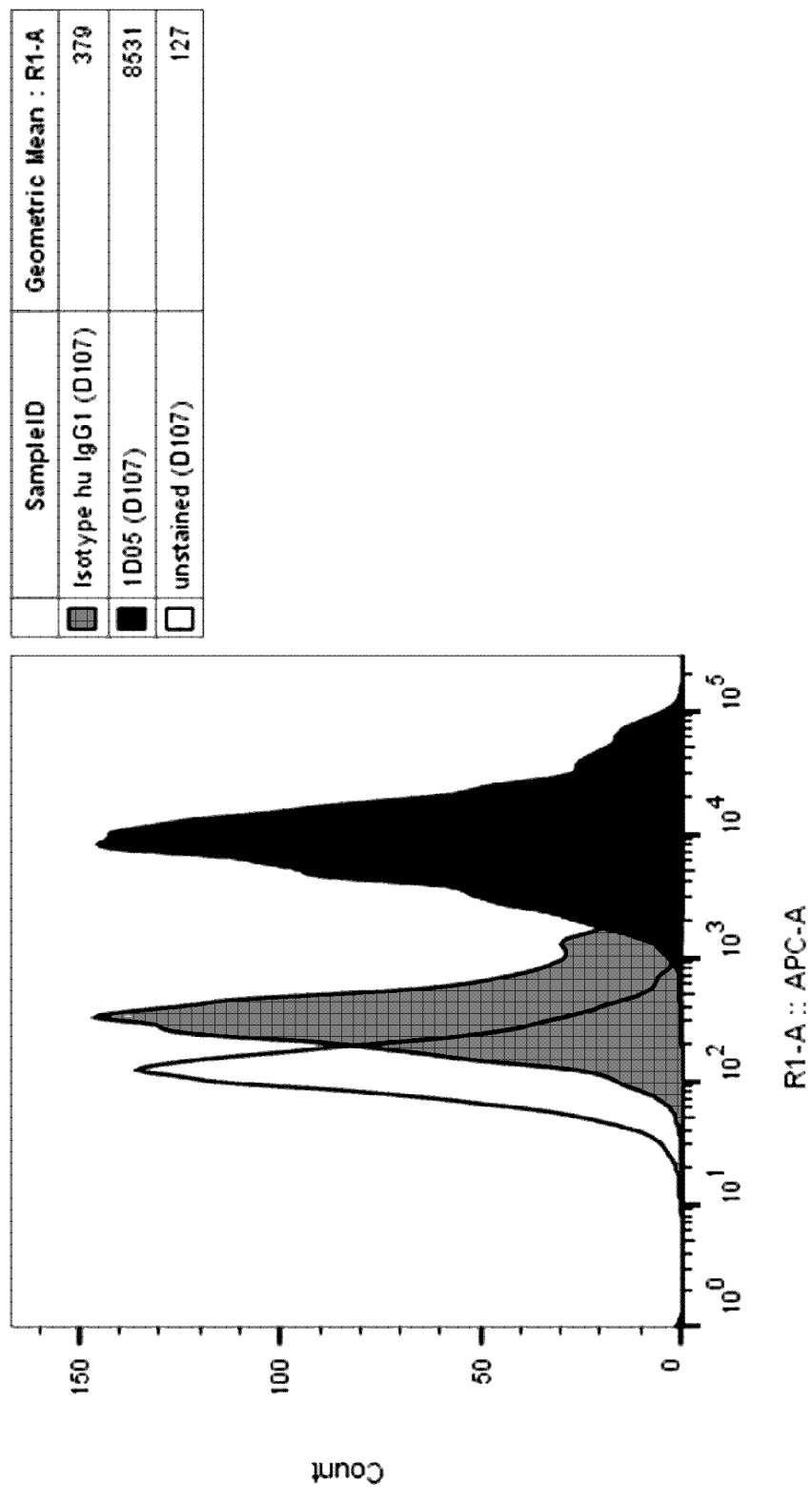
FIG. 7: Lead antibodies bind to natively expressed PD-L1 on dendritic cells. Dendritic cells were generated from monocyte precursors with GM-CSF and IL-4 and stained with lead antibodies (a) 1D05 and (b) 84G09, and isotype control directly labelled with AlexaFluor647. Data shown is from one blood donor, representative of four donors
Figure 7B:
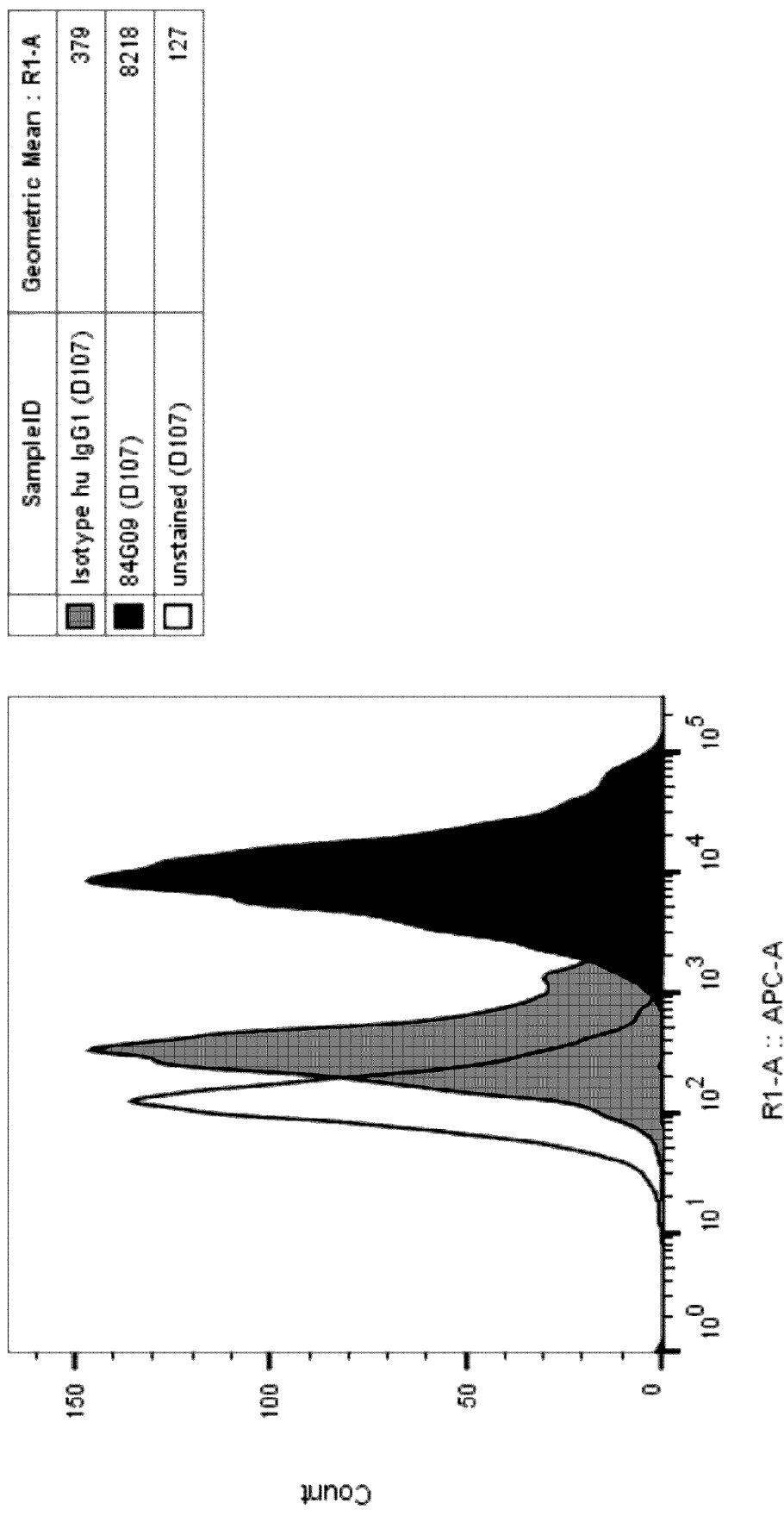

84G09 and 1D05 were labelled with AlexaFluor647 and used to stain dendritic cells derived from monocytic precursors. This shows that lead antibodies bind PD-L1 that is natively expressed on human dendritic cells. Data is shown in FIG. 7.

Materials and Methods

PBMC were suspended in RPMI 1640 medium without additives and allowed to adhere to a tissue culture flask for two hours at 37° C. Non-adherent cells were removed and the flask washed three times with PBS. PBS was removed and replaced with RPMI 10% hiFBS (Gibco) containing 100 ng/mL GM-CSF and IL-4 (both Peprotech). Cells were cultured at 37° C. for 7 days, and then removed from flask using a cell scraper.

Cells were resuspended in FACS buffer (PBS 1% w/v BSA 0.1% w/v sodium azide) and plated at 10$^5$ cells/well, and incubated with Trustain FcX (Biolegend) for 10 min to prevent antibody binding to FcγR. AlexaFluor647 labelled antibodies were added at a final concentration of 5 μg/mL and incubated at 4° C. for 1 hour. Cells were then washed three times in FACS buffer and fixed for 20 min in 4% paraformaldehyde (Affymetrix). After fixation, cells were washed three times as before and resuspended in FACS buffer for analysis by flow cytometry. Data was acquired using the MACSQuant flow cytometer (Miltenyi Biotec) and analysed in FlowJo v10.

Example 6—Antigen Preparation, Immunization Procedures, and Antigen-Specific B Cell Sorting and V-Region Recovery Additional anti-human PD-L1 monoclonal antibodies were generated using the KyMouse™ system previously described. Genetically engineered HK mice were immunized with soluble recombinant human and mouse PD-L1 or surface expressed human and mouse PD-L1 displayed on mouse embryonic fibroblast (MEF) cells. Serum titres were performed by reverse ELISA and mice with the highest titres were selected for processing. At the end of each regime, spleen and lymph nodes were removed. Tissues were prepared into a single cell suspension and stained for sorting antigen-specific B-cells by FACS.

Materials and Methods a) Immunisation of Mice

Mice were immunised with soluble recombinant human PD-L1 or a combination of human and mouse PD-L1 protein (in-house) as per the schedule described in Example 1 for KM032 (hereafter described as KM121). Mice were also immunised with human PD-L1 protein, and MEF cells expressing human or mouse PD-L1, as per the schedule described in Example 1 for KM033 (hereafter described as KM122). MEF cells expressing mouse PD-L1 were gener-

TABLE 3

| Antibody clone ID | V gene | D gene | J gene | CDRH3 length (aa) | non-germline CDRH3 (aa) | V gene | J gene | CDRL3 length (aa) | Non-germline CDRL3 (aa) |
|---|---|---|---|---|---|---|---|---|---|
| 1D05 | IGHV3-9*01 | IGHD3-10*01 | IGHJ5*02 | 16 | 6 | IGKV1D-39*01 | IGKJ5*1 | 9 | 0 |
| 84G09 | IGHV3-9*01 | IGHD3-10*01 | IGHJ5*02 | 15 | 4 | IGKV1D-39*01 | IGKJ5*1 | 9 | 1 |

V region usage of lead antibodies ated as per Example 1, but substituting mouse PD-L1 sequences for the human PD-L1 sequences, and substituting anti-mouse PD-L1 detection antibody (eBioscience) for the anti-human PD-L1 detection antibody.

b) Determining Serum Titre by Reverse PD-L1 ELISA Protocol

Titres in mouse serum samples were determined using a reverse PD-L1 ELISA protocol as per Example 1, with the following changes. In-house generated hPD-L1-his was labelled in-house using Lightning Link kit (Innova Biosciences), and used at 1 µg/mL in reagent diluent; 50 µL/well). Bound hPD-L1 was detected by addition of streptavidin-Europium (Perkin Elmer) diluted 1/1000 in DELFIA assay buffer (Perkin Elmer). Following incubation for 1 hour at room temperature in the dark, plates were washed using TBS (Tris buffered saline)-Tween (0.1% v/v) and 50 µL/well of DELFIA Enhancement solution (Perkin Elmer) was added to the plate. Time-resolved fluorescence was measured at 615 nm on an Envision plate reader (PerkinElmer). Fluorescence data was plotted as Europium counts.

c) Sorting of Antigen-Specific B Cells and Retrieval of V-Regions

The methods used were substantially as described in Example 1 of PCT application WO2015/040401, which is incorporated herein by reference. In brief, splenocytes and lymph node cells isolated from KM121 and KM122 immunisation regimes were stained with an antibody cocktail containing markers for the selection of cells of interest (CD19), whereas unwanted cells were excluded from the final sorted population (IgM, IgD, 7AAD). CD19$^+$ B-cells were further labelled with human PD-L1 (Seq ID No:1) and mouse PD-L1 (Seq ID No:325, labelled with AlexaFluor647 and AlexaFluor488, respectively, in-house using Lightning Link kits) to detect B-cells producing specific antibodies—cells binding human PD-L1, or both human and mouse PD-L1 were selected. These cells were single cell sorted by FACS into lysis buffer. V-region sequences were recovered using RT-PCR and two further rounds of PCR, then bridged to mouse IgG1 constant region and expressed in HEK293 cells. Supernatants from HEK293 cells were screened for the presence of PD-L1 binding antibodies. This method is hereafter referred to as BCT.

Example 7—Supernatant Screening

BCT supernatants were screened by HTRF, and selected primary hits further screened for binding to cell-expressed recombinant hPD-L1 and neutralisation of PD-1 binding, and for affinity of binding to human, cynomolgus and mouse PD-L1 recombinant protein by SPR, as described in this Example. KM121 antibodies with an affinity of 1 nM or better for human and in some cases also cynomolgus PD-L1 were taken forward for further characterisation. For KM122, antibodies with the capacity to neutralise PD-1 binding to cell-expressed PD-L1 were taken forward, along with high affinity (<1 nM) binding to both human and cynomolgus PD-L1. Antibodies did not bind to mouse PD-L1.

a) Primary Screen—Binding to Recombinant Human PD-L1 (BCT Supernatants)

Supernatants collected from BCT expression were screened for the ability of secreted antibodies to bind to hPD-L1 expressed as a recombinant protein (produced in-house). Binding of secreted antibodies to recombinant human and mouse PD-L1 were identified by HTRF® (Homogeneous Time-Resolved Fluorescence, Cisbio) assay format using FluoProbes®647H (Innova Biosciences) labelled PD-L1 (referred to herein as 647 hPD-L1 or 647 mPD-L1 for human PD-L1 and mouse PD-L1 labelled with Fluo-Probes® 647H respectively). 5 µL BCT supernatant was transferred to a white 384-well, low-volume, non-binding surface polystyrene plate (Greiner). 5 µL of 25 nM 647 hPD-L1 or 647 mPD-L1 diluted in HTRF assay buffer was added to all wells. Reference antibody was diluted in BCT media (Gibco #A14351-01) to 40 nM and 5 µL added to plate. For negative control wells, 5 µL of mouse IgG1 (Sigma M9269 in some instances referred to as CM7) diluted to 40 nM in BCT media was added. Binding of secreted antibodies to PD-L1 was detected by addition of 10 µL of goat anti-mouse IgG (Southern Biotech) directly labelled with Europium cryptate (Cisbio) diluted 1/2000 in HTRF assay buffer. The plate was left to incubate in the dark for 2 hours prior to reading time resolved fluorescence at 620 nm and 665 nm emission wavelengths using an EnVision plate reader (Perkin Elmer).

Data were analysed by calculating 665/620 ratio and percent effect for each sample according to Equation 2 and Equation 1 respectively.

For KM121, primary hits were selected based on greater than or equal to 30 percent effect whereas for KM122 primary hits were selected based on greater than or equal to 40 percent effect.

Progression to secondary screen was based on data from recombinant PD-L1 binding.

b) Secondary Screen—Binding to Cell Expressed hPD-L1 and Neutralisation of hPD-L1 Binding to PD-1 (BCT Supernatants)

Binding of BCT supernatants were tested for ability to bind to CHO-S cells expressing hPD-L1. CHO-S cells expressing hPD-L1 (generated in-house), were diluted in FACS buffer (PBS 1% BSA 0.1% sodium azide) and were distributed to a 96-well, V-bottom plate (Greiner) at a density of 0.5-1×10$^5$ cells per well. Cells were washed with 150 µL PBS and centrifuged at 300 g for 3 minutes. Supernatant was aspirated and 150 µL PBS added. This wash step was repeated.

25 µL BCT neat supernatant, reference antibody or control antibody diluted to 300 nM in BCT media was added to the washed cells. 25 µL of 30 nM biotinylated human PD-1 (in-house) was added and cells were incubated at 4° C. for 60 minutes. 150 µL FACS buffer was added and cells washed as described above. To detect biotinylated PD-1 and anti-PD-L1 antibody binding, Streptavidin-647 (Jackson ImmunoResearch) and anti-Mouse PE (Jackson ImmunoResearch) were each diluted 1/500 in FACS buffer and 50 µL of this mixture added to cells. Cells were incubated 4° C. for 60 minutes. Cells were washed twice with 150 µL FACS buffer, centrifuging at 300 g for 3 minutes after each wash step and aspirating supernatant. Cells were fixed by addition of 50 µL 4% paraformaldehyde overnight. Cells were washed once as above and resuspended in FACS buffer for analysis. PE and APC signal intensity (geometric mean) was measured by flow cytometry using a BD FACS Array instrument. Data was plotted as geometric mean values without further calculation.

For KM121, secondary hits were selected based on high affinity (<1 nM) binding to human PD-L1. For KM122, secondary hits were selected based on comparable high affinity (<1 nM) binding human and cynomolgus PD-L1 and ability to neutralise PD-1 binding to cell-expressed PD-L1. Results are summarised in Table 4.

TABLE 4

Summary of BCT clone screening

| Experiment ID | Number of BCT supernatants screened | Number of Primary hits cherry picked | Number of secondary hits confirmed |
|---|---|---|---|
| KM121 | 984 | 162 | 7* |
| KM122 | 1312 | 263 | 45** |

*three of these secondary hits were not included in the primary screen and were screened by SPR and neutralisation only
**one hit was identified by primary screen but insufficient material was available for secondary screen. After re-expression, clone was shown to bind human and cynomolgus PD-L1 with affinity of <1 nM and carried forward c) Analysis of Binding by Surface Plasmon Resonance SPR analysis was carried out on the ProteOn XPR36 Array system. Anti-mouse IgG (GE Healthcare BR-1008-38) was immobilised on a GLM chip by primary amine coupling. Antibodies were directly captured from BCT supernatants. Human, mouse and cynomolgus PD-L1 were used as analytes and passed over the captured antibodies at a single concentration. The binding sensorgrams are double referenced with a 0 nM (ie buffer alone) injection, and the data is analysed using the 1:1 model inherent to the ProteOn analysis software. The assay is carried out at 25° C. and used HBS-EP as running buffer.

Example 8—Characterisation of Selected Antibodies

Figure 8A:
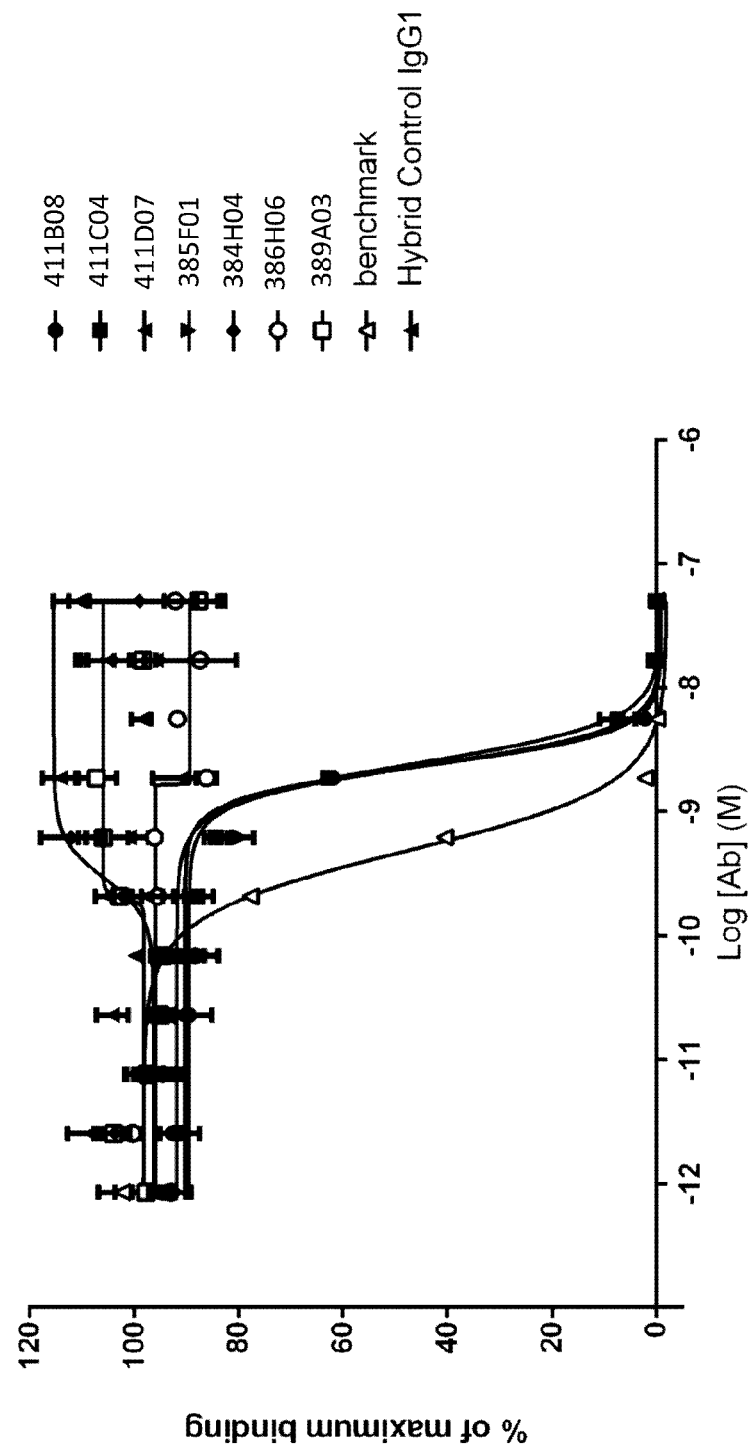
FIG. 8a: PD-L1 direct neutralisation ELISA with PD-1 receptor. Neutralisation profiles of KM121 hits compared to a benchmark anti-PD-L1 antibody and isotype control. Data representative of three independent experiments
Figure 8B:
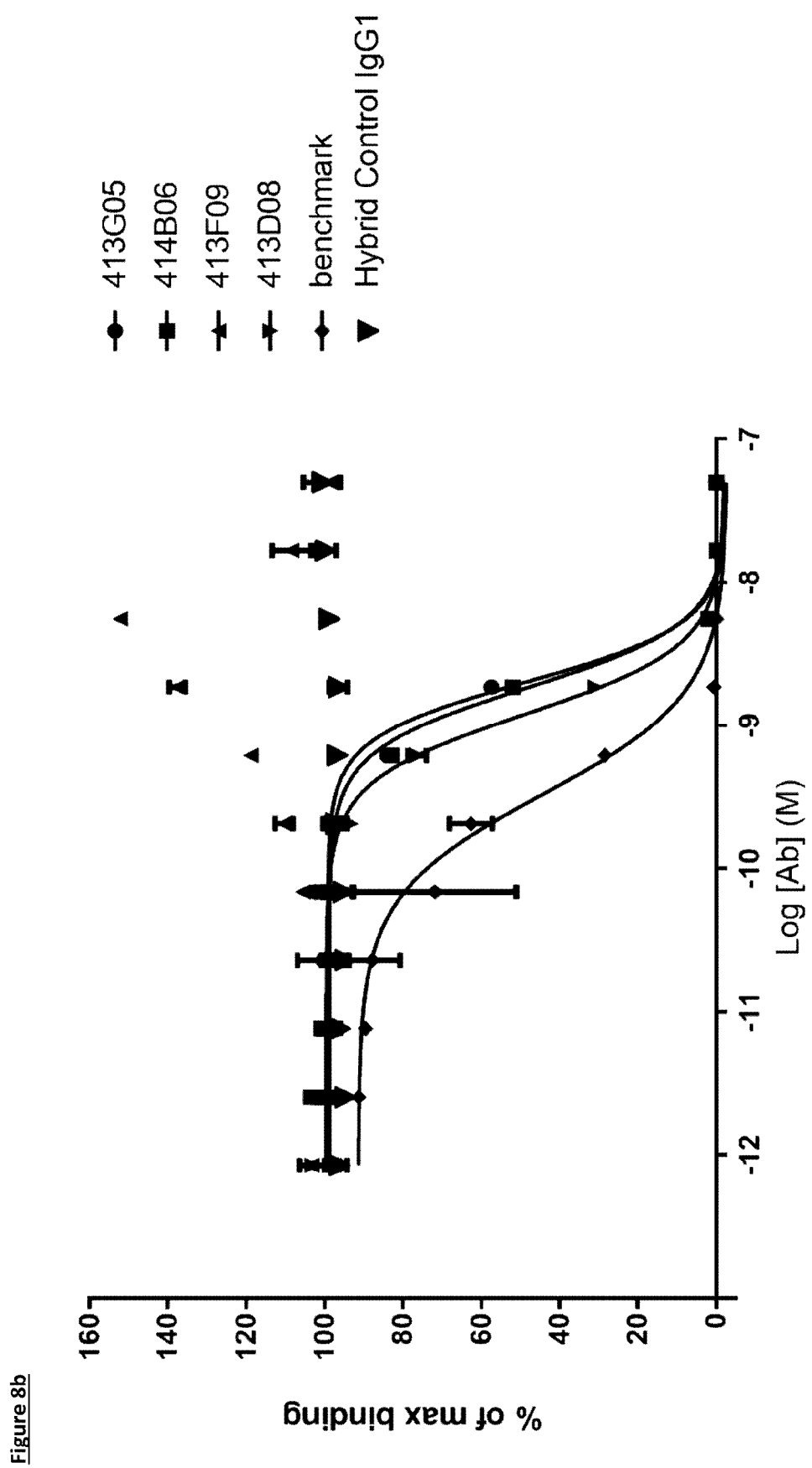
FIG. 8b: PD-L1 direct neutralisation ELISA with PD-1 receptor. Neutralisation profiles of KM122 lead candidate molecules compared to the benchmark anti-PD-L1 antibody. Data is from a single experiment
Figure 8C:
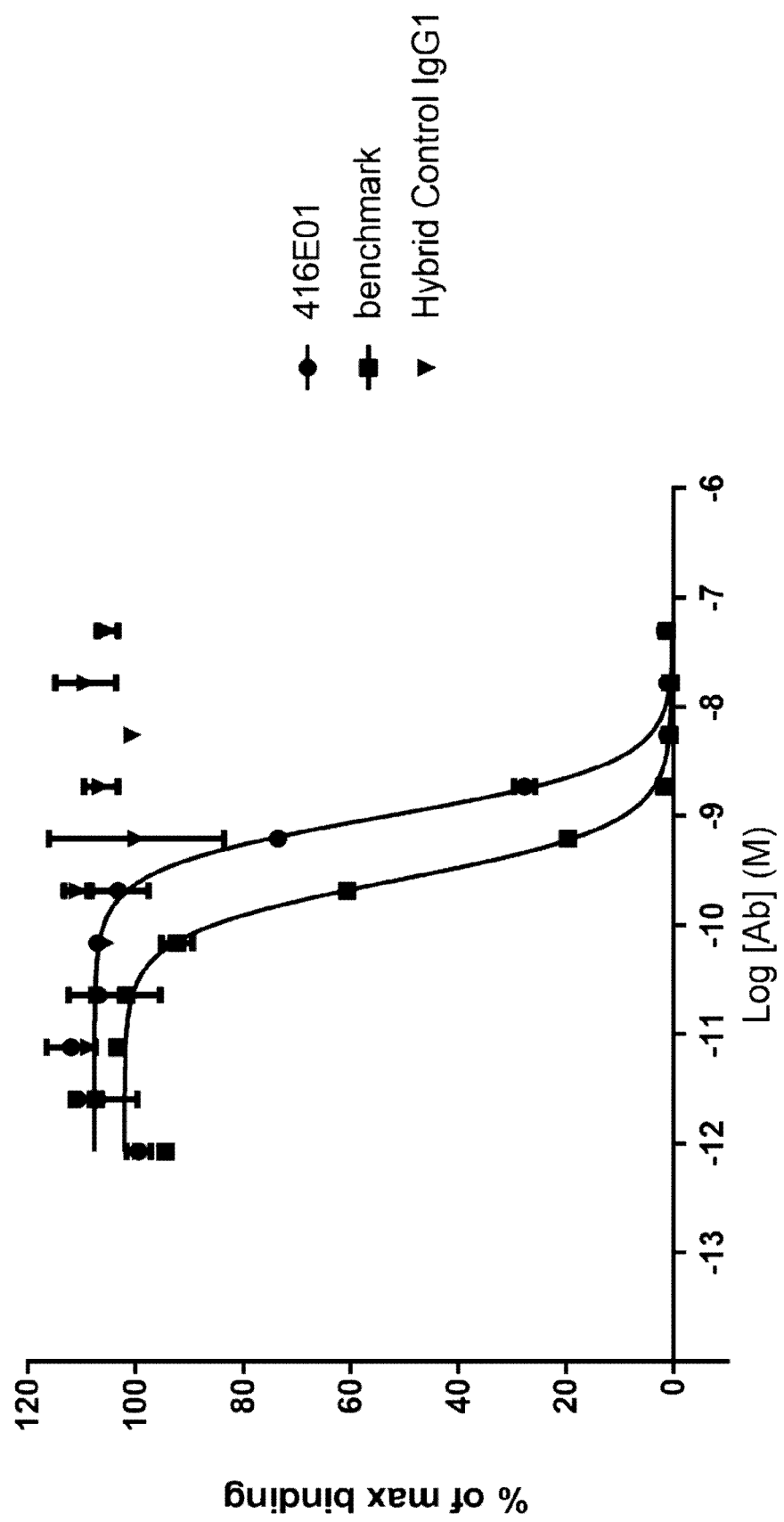
FIG. 8c: PD-L1 direct neutralisation ELISA with PD-1 receptor. Neutralisation profile of KM122 lead candidate molecule 416E01 compared to the benchmark anti-PD-L1 antibody. Data is from a single experiment
Figure 9A:
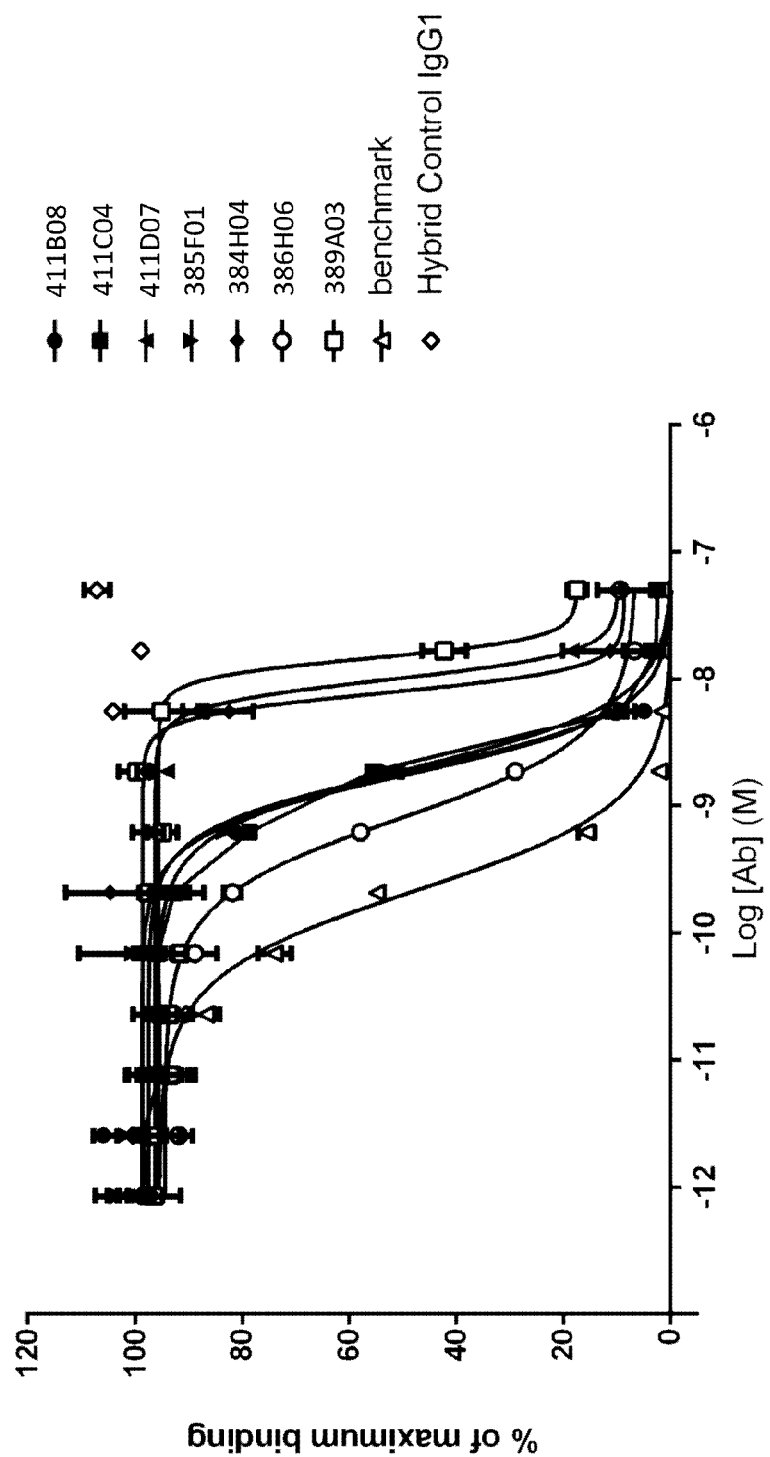
FIG. 9a: PD-L1 direct neutralisation ELISA with CD80 receptor. Neutralisation profiles of KM121 hits compared to a benchmark anti-PD-L1 antibody and isotype control. Data representative of three independent experiments
Figure 9B:
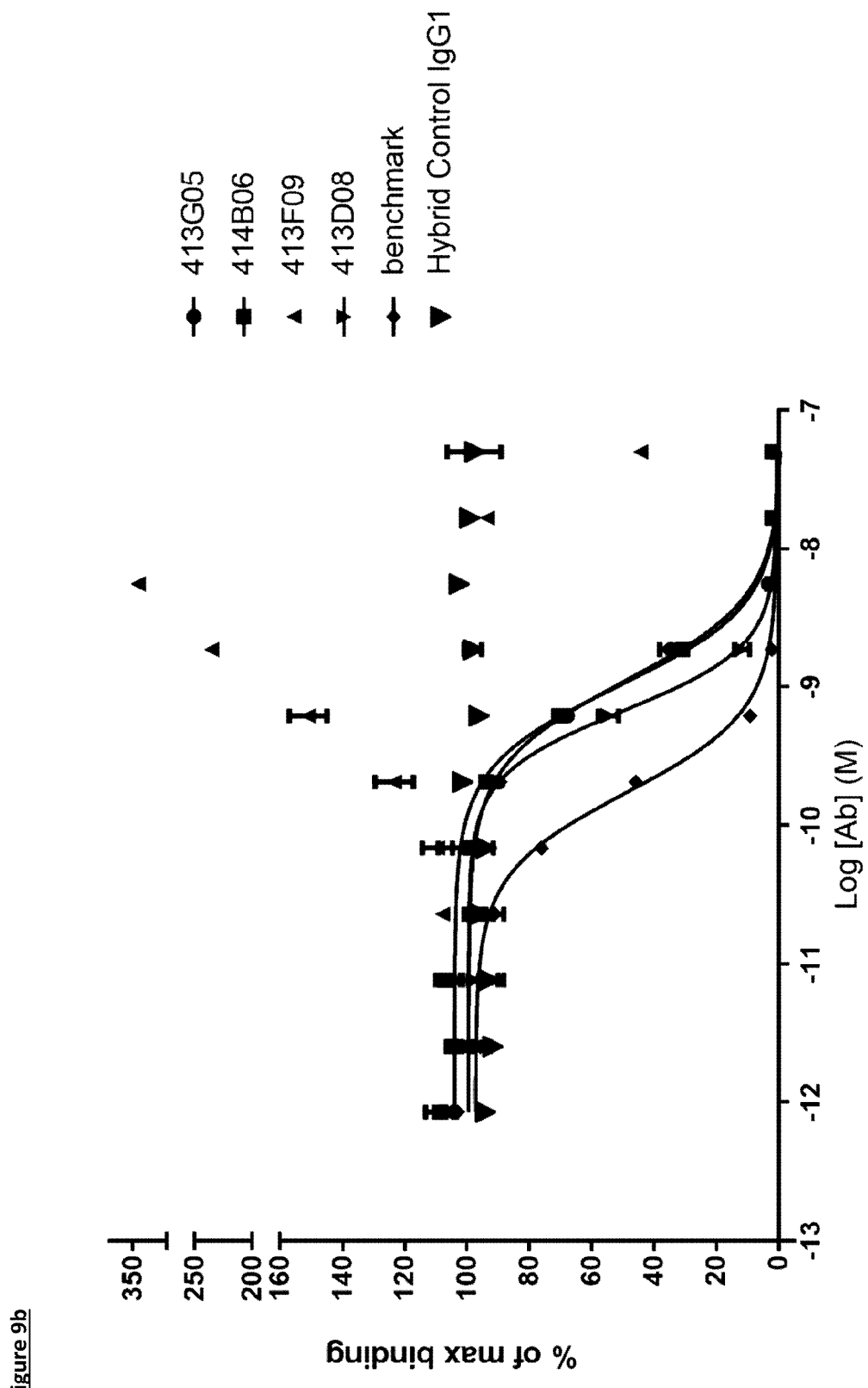
FIG. 9b: PD-L1 direct neutralisation ELISA with CD80 receptor. Neutralisation profiles of KM122 lead candidate molecules compared to the benchmark anti-PD-L1 antibody. Data is from a single experiment
Figure 9C:
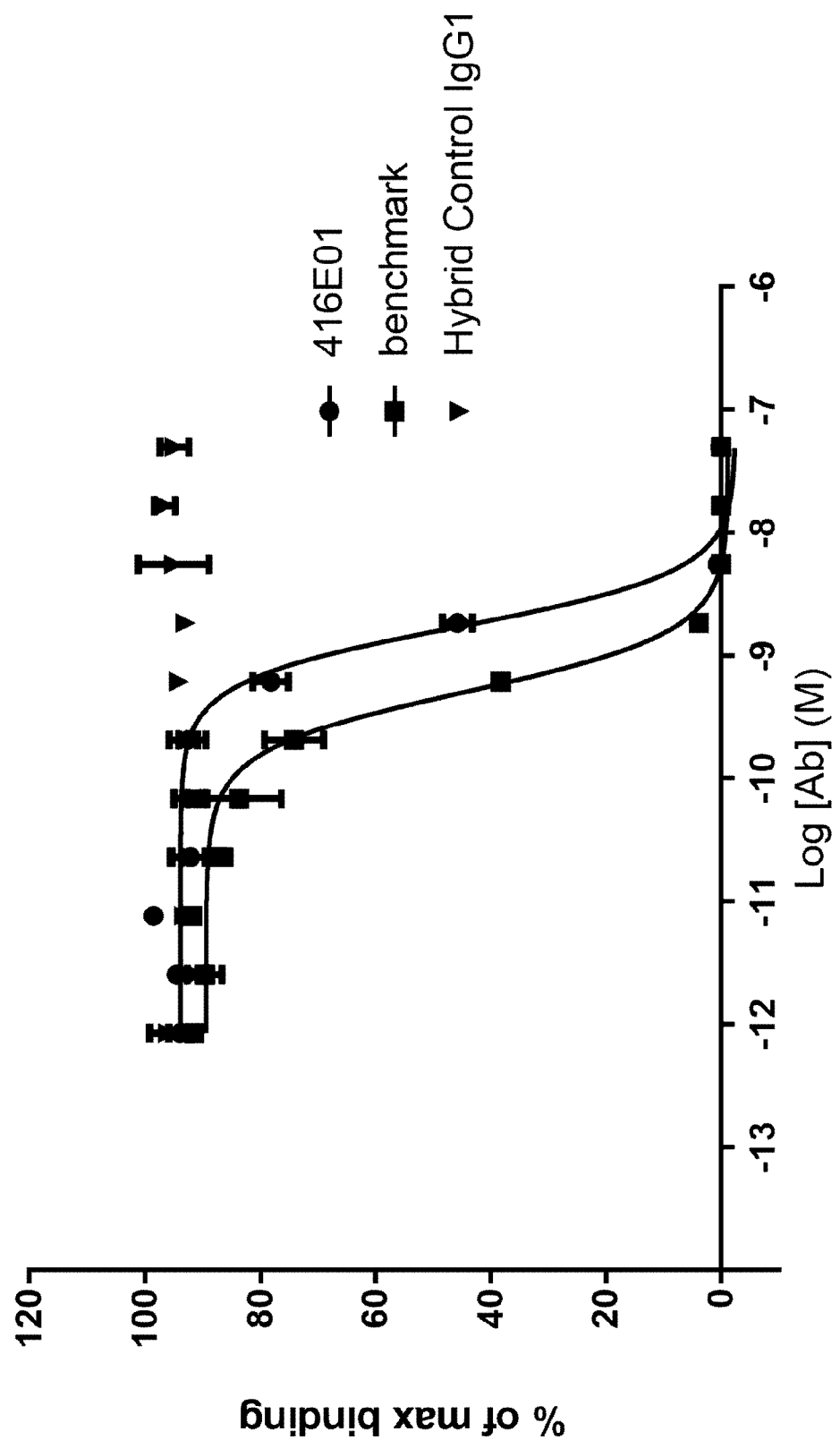
FIG. 9c: PD-L1 direct neutralisation ELISA with CD80 receptor. Neutralisation profiles of KM122 lead candidate molecule 416E01 compared to the benchmark anti-PD-L1 antibody. Data is from a single experiment

Selected hits were re-expressed with a human IgG1 constant region and sent for sequencing at Source Bioscience. V region usage is listed in Table 5. Hits were then analysed in an ELISA to determine their ability to neutralise PD-L1/PD-1 interactions, and PD-L1/CD80 interactions. All seven KM121 hits neutralised PD-L1/CD80 interactions; however, four antibodies did not neutralise PD-L1/PD-1. Four out of five KM122 hits neutralised both PD-L1/PD-1 and PD-L1/CD80 internations. Results are shown in FIGS. 8 and 9. Antibodies shown to neutralise both PD-1 and CD80 interactions with PD-L1 were further screened for their ability to increase IFNγ in an autologous monocyte-T-cell co-culture assay.

Materials and Methods a) PD-L1/PD-1 and PD-L1/CD80 Neutralisation ELISA

CD80 (R&D Systems) or PD-1 (in-house) diluted to 2.5 μg/mL were adsorbed to 96-well, low auto-fluorescent, high protein binding plates (Costar) overnight at 4° C. Excess protein was removed by washing with PBS-Tween (0.1% v/v) and the wells were blocked with 1% w/v bovine serum albumin (BSA, Sigma) in PBS for 1 hour at room temperature, after which plates were washed with PBS-Tween as above. 60 μL of a titration (three-fold serial dilution) of antibody was added to a 96-well, non-binding plate diluted in ELISA assay buffer (PBS+0.1% BSA). 60 μL of biotin labelled PD-L1 at 16 nM working concentration (8 nM FAC) was added to the plate excluding control wells where 60 μL ELISA assay buffer was added. The plate was incubated for 30 minutes before transferring 50 μL to the coated plates. The coated plates were incubated for 1 hour at room temperature. Excess protein was removed by washing with PBS-Tween (0.1% v/v). PD-L1 binding was detected using streptavidin labelled europium (Perkin Elmer) diluted 1/1000 in DELFIA assay buffer (Perkin Elmer). The plates were washed with TBS (Tris buffered saline)-Tween (0.1% v/v) and 50 μL/well of DELFIA Enhancement solution (Perkin Elmer) was added to the plate. Time-resolved fluorescence was measured at 615 nm on an Envision plate reader (PerkinElmer). Percentage specific binding was calculated as defined in Equation 3. $IC_{50}$ values were determined using GraphPad Prism software by curve fitting using a four-parameter logistic equation (Equation 4). Results are shown in Table 4a below. Values for KM121 antibodies are a mean of three independent experiments. Values for KM122 are from a single experiment. ND indicates $IC_{50}$ value not determined, as a complete curve could not be generated.

TABLE 4a $IC_{50}$ values for neutralisation of PD-L1 interactions with PD-1 and CD80

| Regime | Antibody clone ID | PD-1/PD-L1 $IC_{50}$ (nM) | CD80/PD-L1 $IC_{50}$ (nM) |
|---|---|---|---|
| KM121 | 411B08 | 2.22 | 1.60 |
| KM121 | 411C04 | 2.45 | 1.93 |
| KM121 | 411D07 | ND | 9.06 |
| KM121 | 385F01 | 2.25 | 1.76 |
| KM121 | 386H03 | ND | 0.74 |
| KM121 | 389A03 | ND | 13.18 |
| KM122 | 416E01 | 1.72 | 0.98 |
| KM122 | 413G05 | 2.02 | 1.10 |
| KM122 | 414B06 | 1.84 | 1.00 |
| KM122 | 413F09 | ND | ND |
| KM122 | 413D08 | 1.20 | 0.67 |

Selected lead antibodies active in the monocyte-T-cell co-culture assay (see Example 9) were analysed by SPR at 25 and 37° C. Lead antibodies retained sub-nanomolar affinity binding to PD-L1 even at 37° C. Antibodies did not bind mouse PD-L1. Results are shown in Table 4b.

Materials and Methods

SPR analysis was performed as per Example 4 with the following amendments: analysis was performed at 37° C. as well as 25° C. to increase the stringency of the assay. Human, cynomolgus and mouse PD-L1 (his-tagged) were generated in house (Seq ID Nos 3, 5 and 326, respectively).

TABLE 4b

Binding affinities of selected lead antibodies

| Clone ID | Temperature | Antigen | KD (nM) |
|---|---|---|---|
| 413G05 | 25° C. | Human | 0.024<br>Kon = 2.57 μM<br>Koff = 62.3 μM |
| 414B06 | 25° C. | Human | 0.172<br>Kon = 4.09 μM<br>Koff = 0.702 mM |
| 416E01 | 25° C. | Human | 0.193<br>Kon = 2.34 μM<br>Koff = 45.1 mM |
| 413G05 | 25° C. | Cyno | 0.015<br>Kon = 2.66 μM<br>Koff = 38.9 mM |
| 414B06 | 25° C. | Cyno | 0.192<br>Kon = 3.78 μM<br>Koff = 0.726 mM |
| 416E01 | 25° C. | Cyno | 0.411<br>Kon = 2.44 μM<br>Koff = 1.0 mM |
| 413G05 | 37° C. | Human | 0.050<br>Kon = 4.67 μM<br>Koff = 0.235 mM |
| 414B06 | 37° C. | Human | 0.778<br>Kon = 5.88 μM<br>Koff = 4.57 mM |
| 416E01 | 37° C. | Human | 0.511<br>Kon = 4.34 μM<br>Koff = 2.22 mM |

TABLE 4b-continued

Binding affinities of selected lead antibodies

| Clone ID | Temperature | Antigen | KD (nM) |
| --- | --- | --- | --- |
| 413G05 | 37° C. | Cyno | 0.046 |
| | | | Kon = 4.31 μM |
| | | | Koff = 0.197 mM |
| 414B06 | 37° C. | Cyno | 0.794 |
| | | | Kon = 5.02 μM |
| | | | Koff = 3.98 mM |
| 416E01 | 37° C. | Cyno | 0.998 |
| | | | Kon = 4.03 μM |
| | | | Koff = 4.02 mM |

Example 9—Testing of Lead Anti-PD-L1 Antibodies in an Autologous Co-Culture Assay The effects of anti-PD-L1 antibodies on IFNγ production are analysed in a co-culture of purified peripheral blood monocytes and CD45RO⁺ memory T-cells from the same donor. In brief, monocytes are isolated by negative selection using magnetic separation beads (Miltenyi Biotec). CD45RO⁺ T-cells are isolated by a first round of negative selection for CD3⁺ T-cells, and one round of positive selection for CD45RO⁺ cells (Miltenyi Biotec). Cell subsets are co-cultured at a 1:1 ratio in RPMI 10% hiFBS in the presence of anti-CD3 (UCHT1, eBioscience) to provide TCR stimulation, and antibodies under investigation. Supernatants are taken after 4 days for analysis of IFNγ by MSD (Meso Scale Discovery).

The experiments were performed as described, except IFNγ production was measured with the R&D Systems™ Human IFNγ Duoset® ELISA, using DELFIA® Eu-N1 Streptavidin detection.

Figure 37:
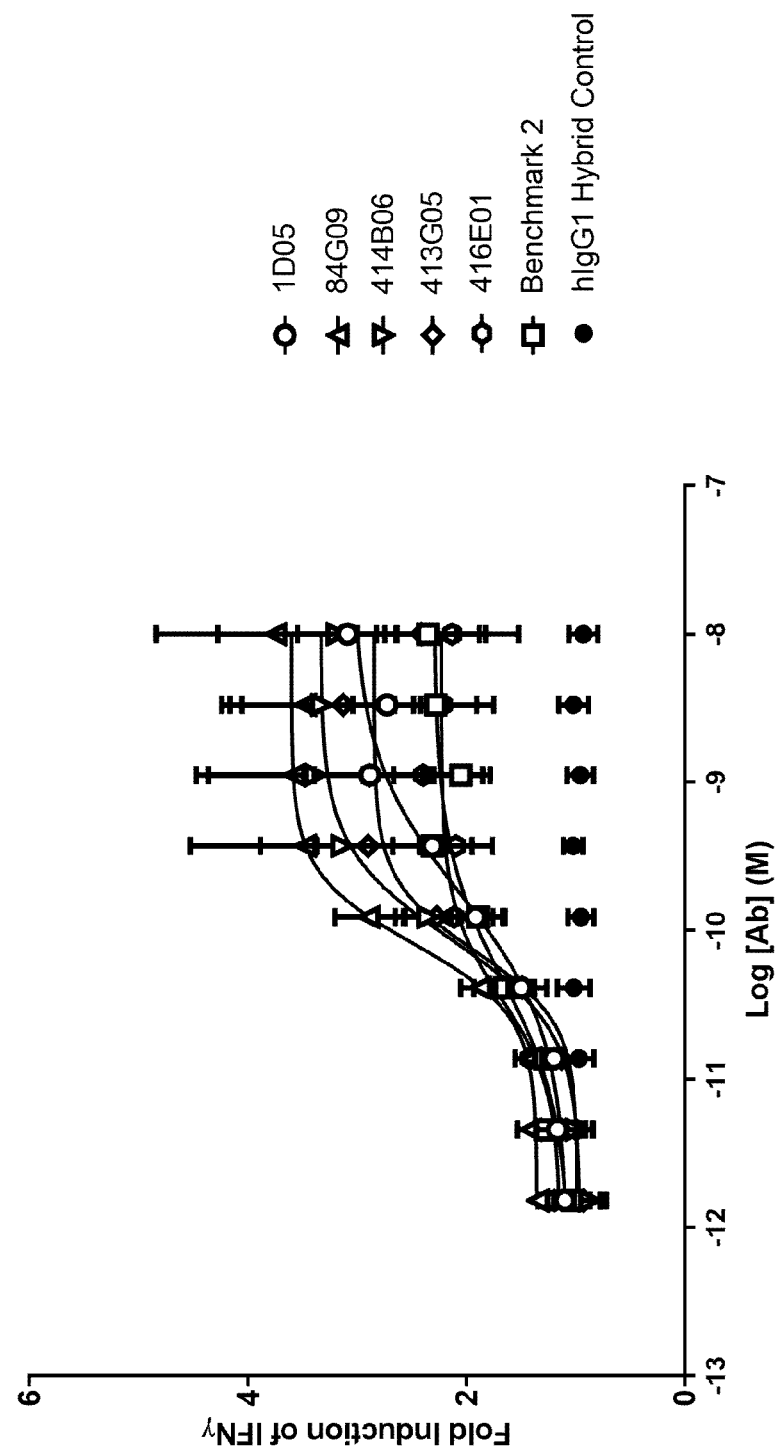
FIG. 37: Induction of IFNγ production in a monocyte-T-cell co-culture assay by anti-PD-L1 antibodies in human IgG1 format. Each data point represents the mean fold induction of IFNγ from at least three independent experiments, ±standard error of the mean

Response for IFNγ standard (pg/mL) was plotted versus relative fluorescence response at 615 nM. IFNγ concentration was interpolated from standard curve in pg/mL using a 4-parameter logistic fit as defined by Equation 4. Antibody-induced IFNγ is represented as fold induction compared to assay signal of wells showing background levels of response as defined in Equation 6. Each plot represents mean fold induction for individual donors with at least 2 different donors represented versus antibody concentration Log (M). Results are shown in FIGS. 22 and 37.

Fold induction=assay response (pg/mL)/background response (pg/mL)   Equation 6

Background IFNγ response=IFNγ concentration (pg/mL) from wells containing monocyte—T-cell co-culture with anti-CD3 stimulation, without antibody.

Figure 22A:
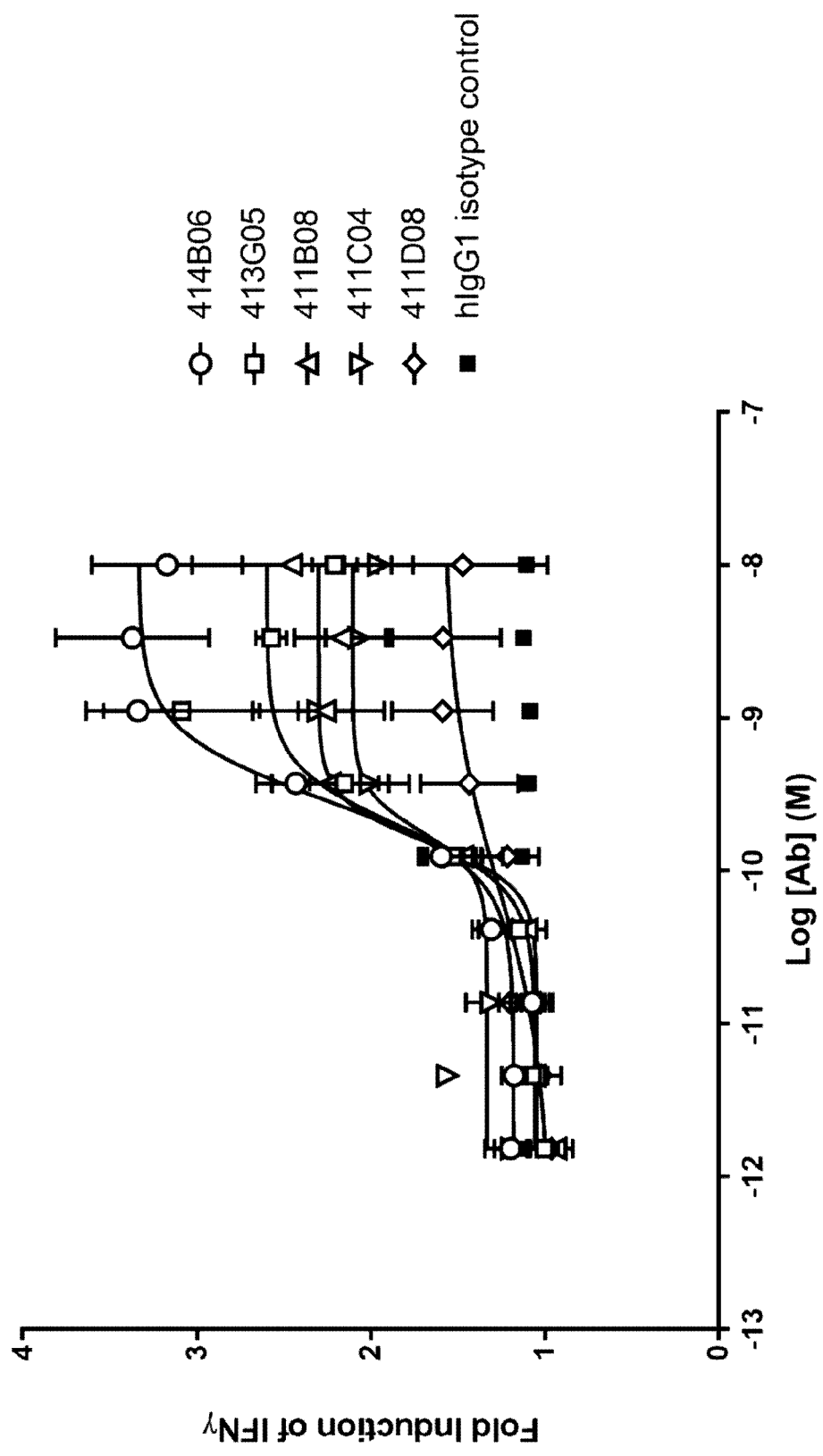
FIG. 22a: Induction of IFNγ production in a monocyte-T-cell co-culture assay by anti-PD-L1 antibodies in human IgG1 format. Each data point represents the mean fold induction from at least three independent experiments, ±standard error of the mean
Figure 22B:
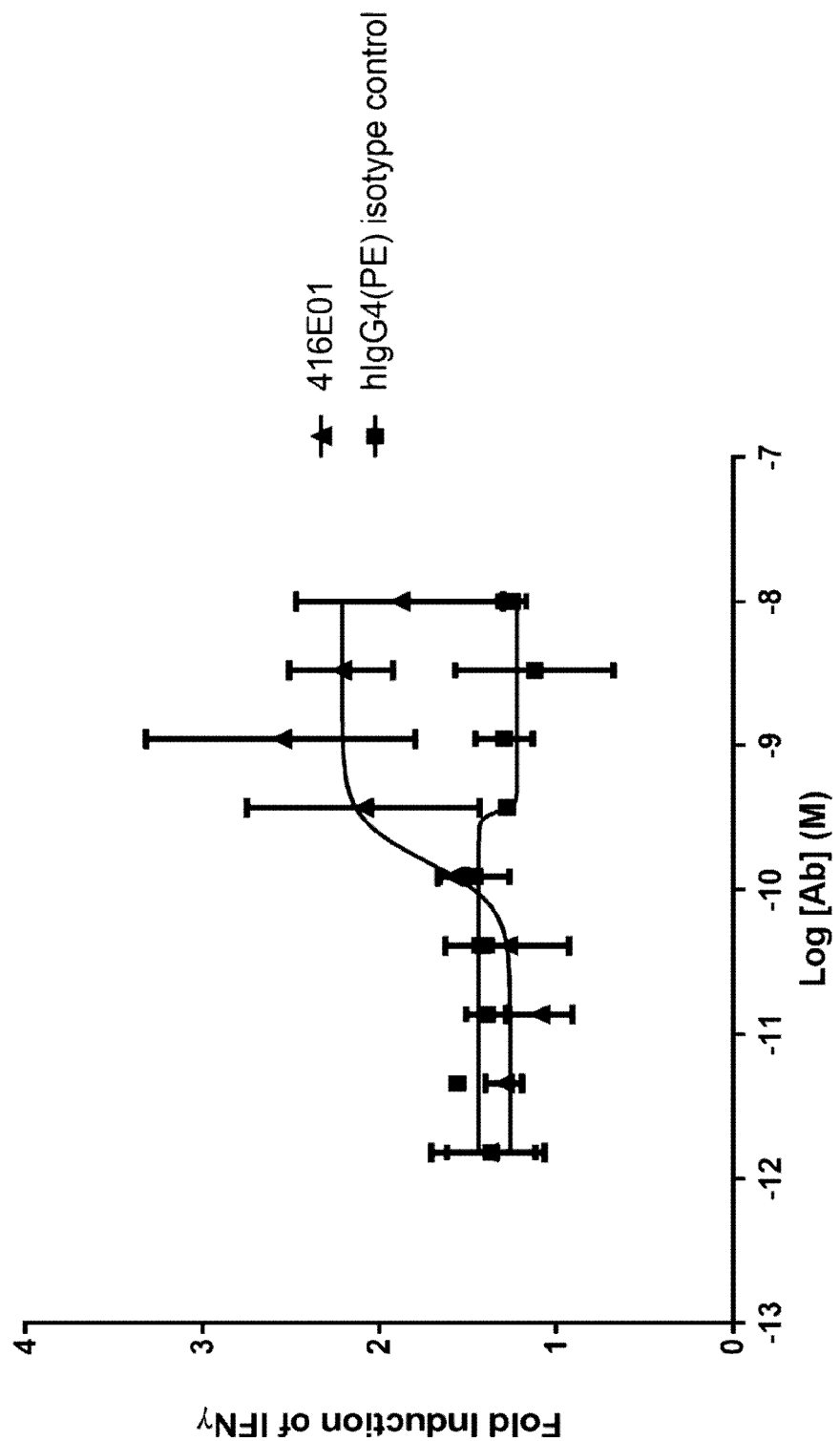
FIG. 22b: Induction of IFNγ production in a monocyte-T-cell co-culture assay by an anti-PD-L1 antibody in human IgG4(PE) format. Each data point represents the mean fold induction from two independent experiments, ±standard deviation

All five antibodies, in human IgG1 format, induced a specific, dose-dependent increase in IFNγ production by T-cells after 4 days of co-culture with autologous monocytes and anti-CD3 (see FIGS. 22a and 22b). The two antibodies that induced the highest increase in cytokine production, 413G05 and 414B06, were selected for repeat characterisation by SPR (see Example 8). Antibody 416E01, in human IgG4(PE) format (Seq ID No:199), also induced specific dose-dependent increase in IFNγ production in the co-culture assay. This antibody was also selected for repeat SPR analysis.

The three selected antibodies were also analysed alongside the two lead antibodies selected in Example 4 (1D05 and 84G09), and a commercial effector enabled benchmark antibody. Antibodies were formatted as human IgG1. All antibodies induced dose-dependent IFNγ production in this assay (FIG. 37 and Table 22).

TABLE 5

V Gene usage for antibody leads

| Regime | Antibody clone ID | V gene | D gene | J gene | CDHR3 length (aa) | Non-germline CDRH3 (aa) | V gene | J gene | CDRL3 length (aa) | Non-germline CDRL3 (aa) |
| --- | --- | --- | --- | --- | --- | --- | --- | --- | --- | --- |
| KM121 | 411B08 | IGHV3-7*01 | IGHD4-11*01 | IGHJ4*02 | 12 | 7 | IGKV1D-12*02 | IGKJ3*01 | 9 | 1 |
| KM121 | 411C04 | IGHV3-7*01 | IGHD4-11*01 | IGHJ4*02 | 12 | 6 | IGKV1D-12*02 | IGKJ3*01 | 9 | 1 |
| KM121 | 411D07 | IGHV4-4*02 | IGHD3-10*01 | IGHJ4*02 | 8 | 1 | IGKV4-1*01 | IGKJ2*04 | 8 | 2 |
| KM121 | 386H03 | IGHV4-4*02 | IGHD3-10*01 | IGHJ4*02 | 8 | 2 | IGKV4-1*01 | IGKJ2*04 | 8 | 1 |
| KM121 | 389A03 | IGHV4-39*01 | IGHD6-13*01 | IGHJ1*01 | 13 | 6 | IGKV4-1*01 | IGKJ1*01 | 9 | 1 |
| KM121 | 385F01 | IGHV3-7*01 | IGHD4-11*01 | IGHJ4*02 | 12 | 7 | IGKV1D-12*02 | IGKJ3*01 | 9 | 1 |
| KM122 | 413D08 | IGHV3-33*01 | IGHD5-18*01 | IGHJ6*02 | 11 | 3 | IGKV1-17*01 | IGKJ1*01 | 9 | 1 |
| KM122 | 413G05 | IGHV3-11*01 | IGHD1-20*01 | IGHJ6*02 | 16 | 5 | IGKV1D-12*02 | IGKJ4*01 | 9 | 1 |
| KM122 | 413F09 | IGHV3-23*04 | IGHD5-18*01 | IGHJ4*02 | 16 | 8 | IGKV1-9*d01 | IGKJ5*01 | 9 | 3 |
| KM122 | 414B06 | IGHV3-7*01 | IGHD5-24*01 | IGHJ4*02 | 12 | 6 | IGKV1D-12*02 | IGKJ3*01 | 9 | 0 |
| KM122 | 416E01 | IGHV3-23*04 | IGHD6-13*01 | IGHJ4*02 | 14 | 10 | IGKV1D-12*02 | IGKJ5*01 | 9 | 2 |

TABLE 22

Summary of data from monocyte-T cell co-culture experiments.

| Antibody name | mean EC50 (nM) | mean fold increase IFNγ |
| --- | --- | --- |
| 1D05 | 0.21 | 3.04 |
| 84G09 | 0.081 | 3.60 |
| 413G05 | 0.082 | 2.85 |
| 414B06 | 0.012 | 3.33 |
| 416E01 | 0.064 | 2.23 |
| benchmark 2 | 0.057 | 2.30 |

Example 10—Bispecific FIT-Ig Molecules Targeting PD-L1 and TIGIT

Bispecific FIT-Ig constructs were constructed substantially as described in Example 1 of International Application WO2015/103072 (in the name of EpiMab Biotherapeutics, and is incorporated herein by reference).

The bispecific constructs, having a FIT-Ig structure, as described in FIG. 1 of WO2015/103072 were expressed in CHO cells with a vector ratio of: Construct 1 DNA: 50%, Construct 2: DNA 25%: Construct 3 DNA 25% of total DNA in the transient transfection. The bispecific molecules were purified by standard Protein A and size exclusion chromatography. In this regard, Construct 1 is the polypeptide chain made up of $VL_A$-CL-$VH_B$-CH1-CH2-CH3 in FIG. 1 of WO2015/103072. Construct 2 is the polypeptide chain made up of $VH_A$-CH1 in FIG. 1 of WO2015/103072, and Construct 3 is the polypeptide chain made up of $VL_B$-CL in FIG. 1 of WO2015/103072.

SPR analysis was used to determine affinities of the various arms of the bispecific and the parental monospecific antibodies were used to determine if the affinities had been altered in the bispecific molecule. Sequential binding of antigens were used to test whether the bispecific constructs were capable of binding on both arms of the bispecific.

TABLE 6

Bispecific antibody constructs and control monospecific antibodies

| Full name | Alias | Native variable domain[1] | Additional Domain[2] |
|---|---|---|---|
| 1D05/in-house anti-TIGIT (KY23) | Bispecific 1 | 1D05 (anti-PD-L1)* | Kymab TIGIT (KY23) |
| In-house anti-TIGIT (KY23)/1D05 | Bispecific 2 | Kymab TIGIT (KY23) | 1D05 (anti-PD-L1)* |
| Tool anti-TIGIT/Tool anti-PD-L1 | Bispecific 3 | Tool anti-TIGIT | Tool anti-PD-L1 |
| Tool anti-PD-L1/Tool anti-TIGIT | Bispecific 4 | Tool anti-PD-L1 | Tool anti-TIGIT |
| 1D05 | Antibody 1 | In-house anti-PD-L1* | na |
| Kymab TIGIT (KY23) | Antibody 2 | In-house anti-TIGIT | na |
| Tool PD-L1 | Antibody 3 | Tool anti-PD-L1 | na |
| Tool TIGIT | Antibody 4 | Tool anti-TIGIT | na |

*1D05 has the $V_H$ sequence of Seq ID No: 33 and the $V_L$ sequence of Seq ID No: 43, and a heavy chain constant region of Seq ID No: 205
[1]"Native Variable domain" corresponds to the antigen-binding site formed by $VH_B$ and $VL_B$ in FIG. 1 of WO2015/103072
[2]"Additional domain" corresponds to the antigen binding site formed by VHA and VLA in FIG. 1 of WO2015/103072Aa) Kinetic analysis An anti-human IgG capture surface was created by a mix of 3 anti-human Fc antibodies (Jackson Labs 109-005-008, 109-006-008 and 309-006-008) immobilised on a GLC chip by primary amine coupling. Control monospecific antibodies or Bispecific antibody constructs were captured on this surface and human PD-L1 or TIGIT was used as analyte at 512 nM, 128 nM, 32 nM, 8 nM and 2 nM with 0 nM (i.e. buffer alone) used to double reference the binding sensorgrams. The assay was run at 25° C., using HBS-EP as running buffer. The sensorgrams were fitted to the 1:1 model inherent to the ProteOn analysis software.

TABLE 7

TIGIT Binding

| Full name | Alias | Ka | Kd | KD (nM) |
|---|---|---|---|---|
| 1D05/in-house anti-TIGIT (KY23) | Bispecific 1 | 2.38E+06 | 2.65E−03 | 1.11 |
| In-house anti-TIGIT (KY23)/1D05 | Bispecific 2 | 1.12E+06 | 2.02E−03 | 1.8 |
| Tool anti-TIGIT/Tool anti-PD-L1 | Bispecific 3 | 2.10E+06 | 3.69E−03 | 1.75 |
| Tool anti-PD-L1/Tool anti-TIGIT | Bispecific 4 | 3.22E+06 | 2.98E−03 | 0.93 |
| 1D05 | Antibody 1 | nbs | nbs | nbs |
| Kymab TIGIT (KY23) | Antibody 2 | 1.58E+06 | 2.27E−03 | 1.44 |
| Tool PD-L1 | Antibody 3 | nbs | nbs | nbs |
| Tool TIGIT | Antibody 4 | 3.16E+06 | 5.42E−03 | 1.72 |

TABLE 8

PD-L1 Binding

| Full name | Alias | Ka | Kd | KD (nM) |
|---|---|---|---|---|
| 1D05/in-house anti-TIGIT (KY23) | Bispecific 1 | 6.03E+05 | 1.61E−04 | 0.27 |
| In-house anti-TIGIT (KY23)/1D05 | Bispecific 2 | 1.04E+06 | 2.14E−04 | 0.21 |
| Tool anti-TIGIT/Tool anti-PD-L1 | Bispecific 3 | 1.25E+06 | 1.22E−04 | 0.1 |
| Tool anti-PD-L1/Tool anti-TIGIT | Bispecific 4 | 7.36E+05 | 1.57E−04 | 0.21 |
| 1D05 | Antibody 1 | 9.71E+05 | 3.36E−04 | 0.35 |
| Kymab TIGIT | Antibody 2 | nbs | nbs | nbs |

TABLE 8-continued

PD-L1 Binding

| Full name | Alias | Ka | Kd | KD (nM) |
|---|---|---|---|---|
| Tool PD-L1 | Antibody 3 | 1.05E+06 | 2.08E−04 | 0.2 |
| Tool TIGIT | Antibody 4 | nbs | nbs | nbs | b) Bispecific Binding

Figure 10:
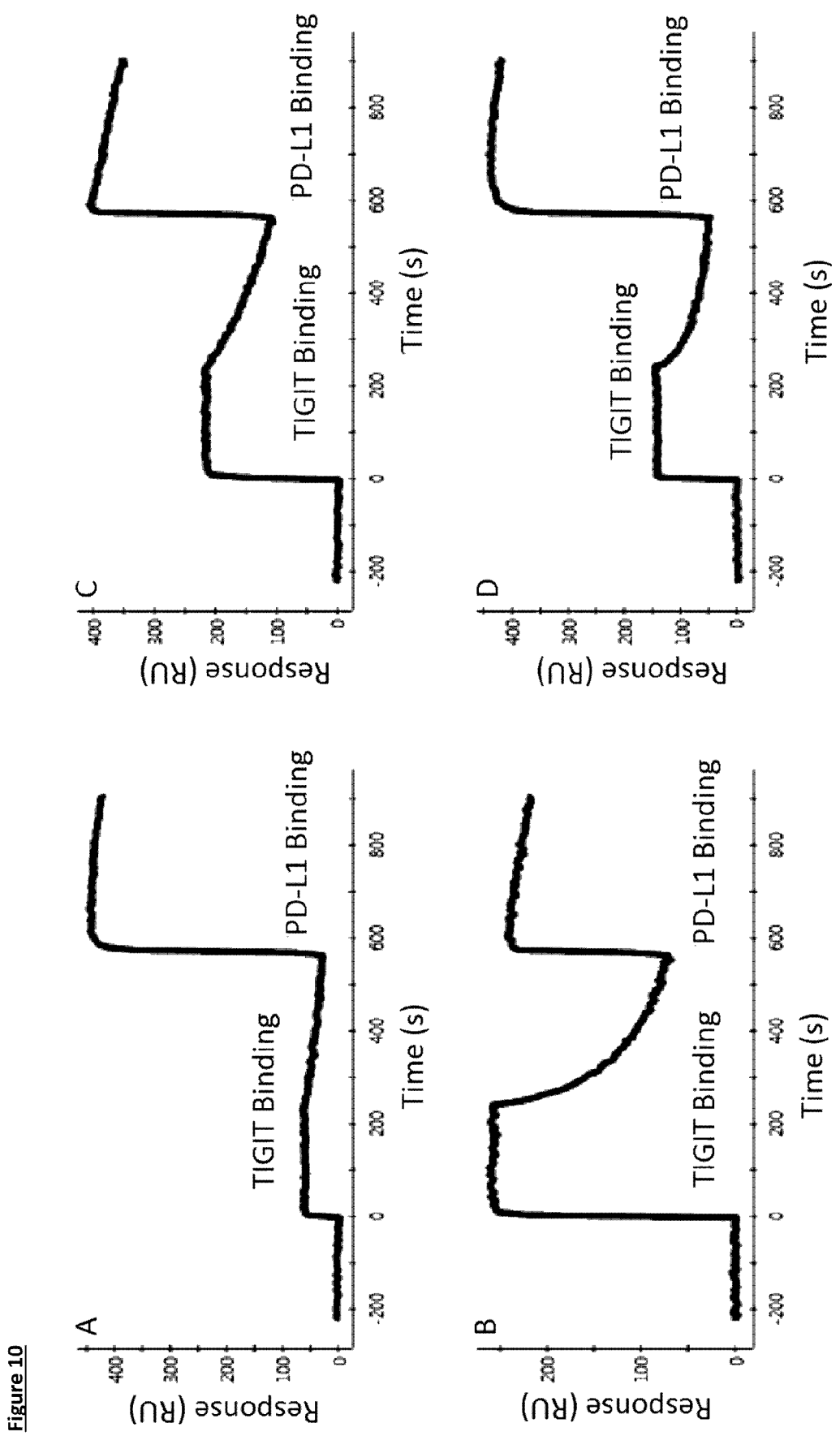
FIG. 10: Bispecific binding as measured by SPR, with PD-L1 as first antigen, and TIGIT as second antigen. A) Bispecific 1, B) Bispecific 2, C) Bispecific 3, D) Bispecific 4. For detailed construction information of each Bispecific construct, see Table 6
Figure 11:
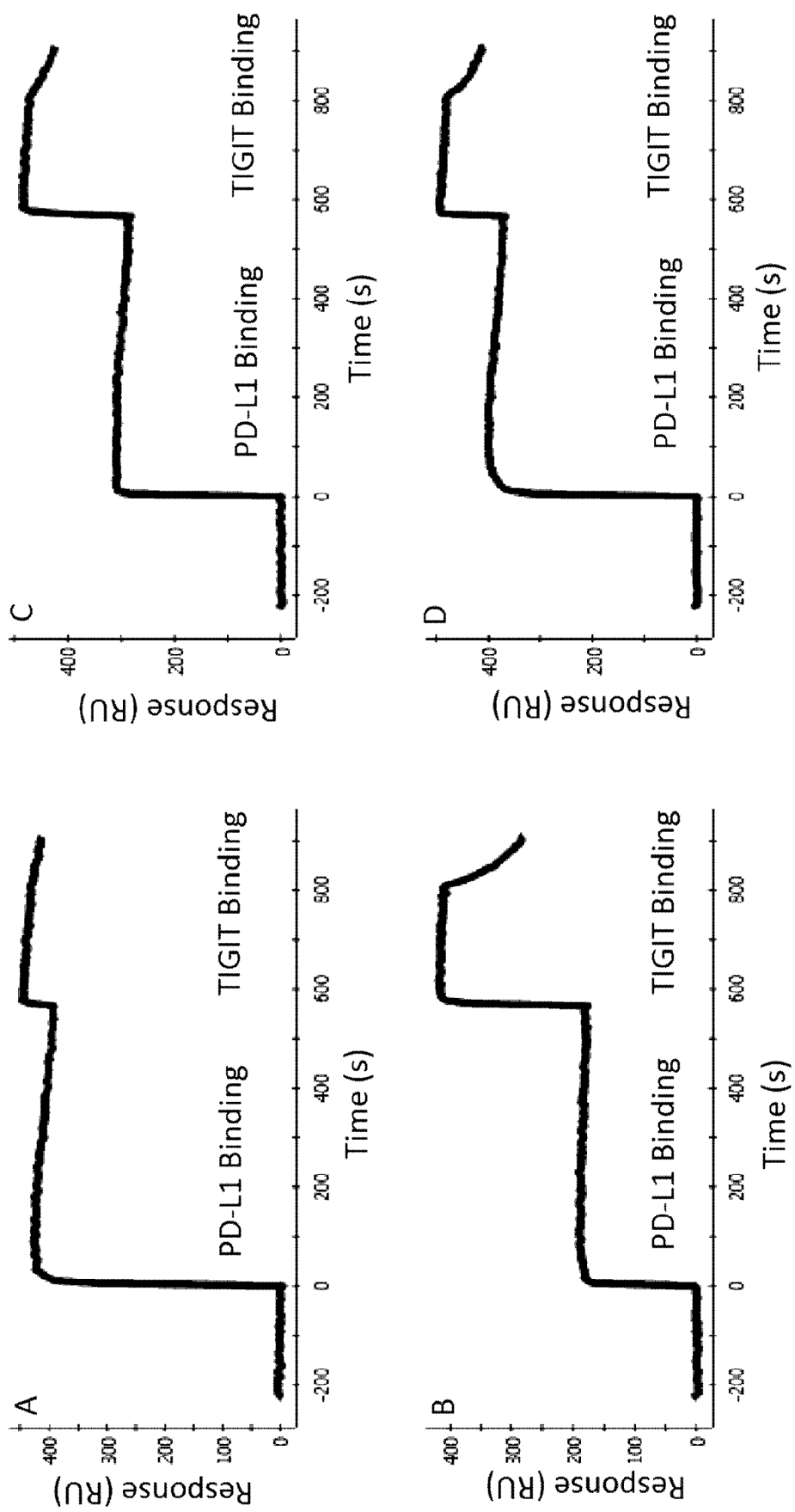
FIG. 11: Bispecific binding as measured by SPR, with TIGIT as first antigen, and PD-L1 as second antigen. A) Bispecific 1, B) Bispecific 2, C) Bispecific 3, D) Bispecific 4. For detailed construction information of each Bispecific construct, see Table 6

Using the same anti-human IgG capture surface created for kinetic analysis, the bispecific antibody constructs were captured on this surface and recombinant PD-L1 or TIGIT was used as analyte at 512 nM, 128 nM, 32 nM, 8 nM and 2 nM with 0 nM (i.e. buffer alone) used to double reference the binding sensorgrams. The assay was carried out by injecting PD-L1 followed by TIGIT with no regeneration between analyte injections, and also with TIGIT followed by PD-L1. The sensorgrams for the double referenced 512 nM are shown in FIGS. 10 and 11.

c) Characterisation of Bispecific FIT-Ig Molecules Binding to PD-L1 and TIGIT by AlphaScreen®

An AlphaScreen® binding assay was developed to assess the bispecific binding of PD-L1/TIGIT FIT-Ig molecules. The assay was set up using biotinylated His-PD-L1 (SEQ ID No:3) and His-FLAG-TIGIT (SEQ ID No:539) detected respectively with streptavidin donor beads and anti-FLAG acceptor beads (both Perkin Elmer, 6760613). Human IgG1 (Sigma I5154) and parental monospecific antibodies alone or in combination were used as negative controls, while an anti-His antibody (Qiagen 34660) was used as positive control.

Two protocols were created to investigate the ability of FIT-Ig molecules to promote proximity of TIGIT and PD-L1 coated beads with a distinct stringency. Antibodies were either incubated with PD-L1 and TIGIT proteins before adding the AlphaScreen® detection beads (Method one), or incubated with the detection beads pre-coated with their respective TIGIT and PD-L1 proteins (Method two). Method two was designed to mimic the cell recruitment by bispecific antibodies.

i) Method One

Figure 25A:
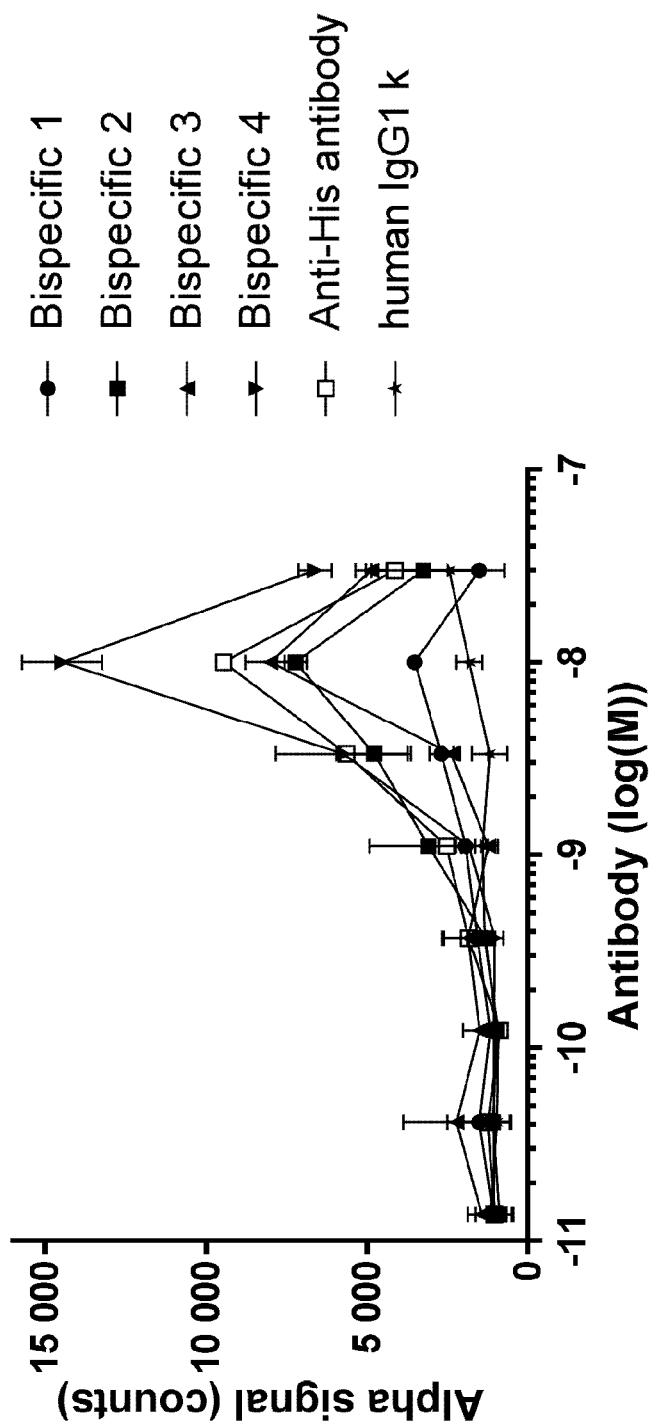
FIG. 25: Titration of FIT-Ig molecules, parental monospecific antibodies, and control antibodies in PD-L1/TIGIT AlphaScreen® Binding Assay using method one. Antibodies were incubated with PD-L1 and TIGIT proteins for an hour before the addition of AlphaScreen® acceptor beads for an hour followed by the addition of AlphaScreen® donor beads for another hour prior to the detection of fluorescence. A) Titration of FIT-Ig molecules; B) Titration of monospecific antibodies. Data shown are representative of one unique experiment
Figure 25B:
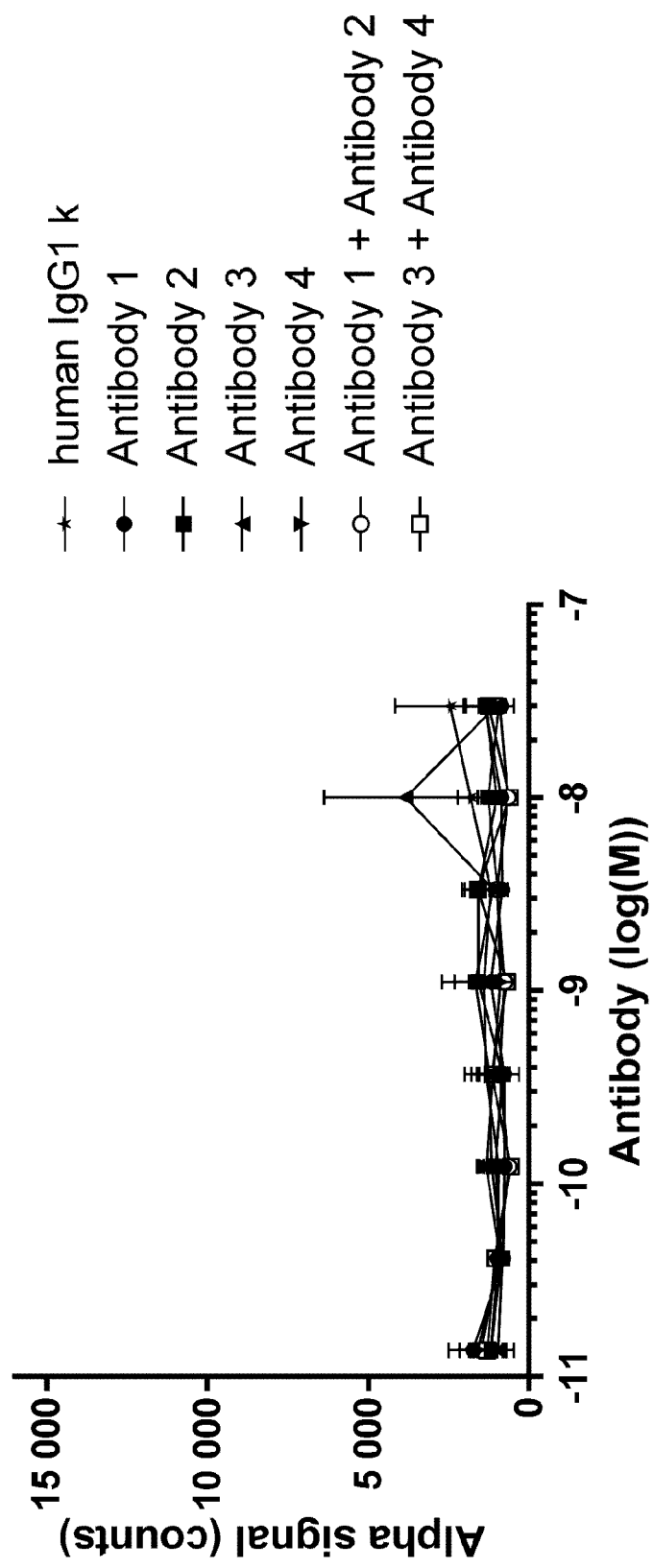

Bispecific antibodies, parental monospecific antibodies and control antibodies were prepared in buffer (PBS pH 7.4 (Gibco) and 0.1% w/v BSA (Sigma)) at 150 nM and diluted as per 1:3 series, 8 points. 5 µL of each serial dilution of antibody were mixed in a 384-well AlphaLISA® assay plate (Perkin Elmer 6005350) to 5 µL of biotinylated His-PD-L1 and 5 µL of His-FLAG-TIGIT at 50 nM in buffer. Parental monospecific antibodies were also prepared as described above starting from 300 nM to be tested in combination. 2.5 µL of the first antibody was added to the same volume of the second antibody, then 5 µL of each combination of parental monospecific antibodies were mixed in assay plates to 5 µL of biotinylated His-PD-L1 and 5 µL of His-FLAG-TIGIT at 50 nM in buffer. Assay plates were incubated for 1 hour at room temperature before adding 5 µL of anti-FLAG acceptor beads at 0.1 g/L for an additional hour at room temperature in the dark. Finally, 5 µL of streptavidin donor beads at 0.1 g/L were added to assay plates for 2 hours and 30 minutes. Assay plates were read using an EnVision plate reader (Perkin Elmer) with excitation/emission wavelengths of 680/615 nm. The fluorescent counts measured (Alpha signal) were plotted in Prism against antibody titrations. Results are shown in FIG. 25. Binding of FIT-Ig molecules to PD-L1 and TIGIT increases with the concentration of antibody up to 10 nM. No binding is observed for the monospecific parental antibodies and the isotype control.

ii) Method Two

Streptavidin donor beads prepared at 0.05 g/L in buffer (PBS pH 7.4 (Gibco 14190169) and 0.1% w/v BSA (Sigma)) were coated with biotinylated His-PD-L1 (Seq ID No:3) at 25 nM, while His-FLAG-TIGIT (Seq ID No:539) at 25 nM was used to label anti-FLAG acceptor beads at 0.05 g/L in buffer. Both acceptor and donor beads were incubated for 1 hour at room temperature in the dark.

Figure 26A:
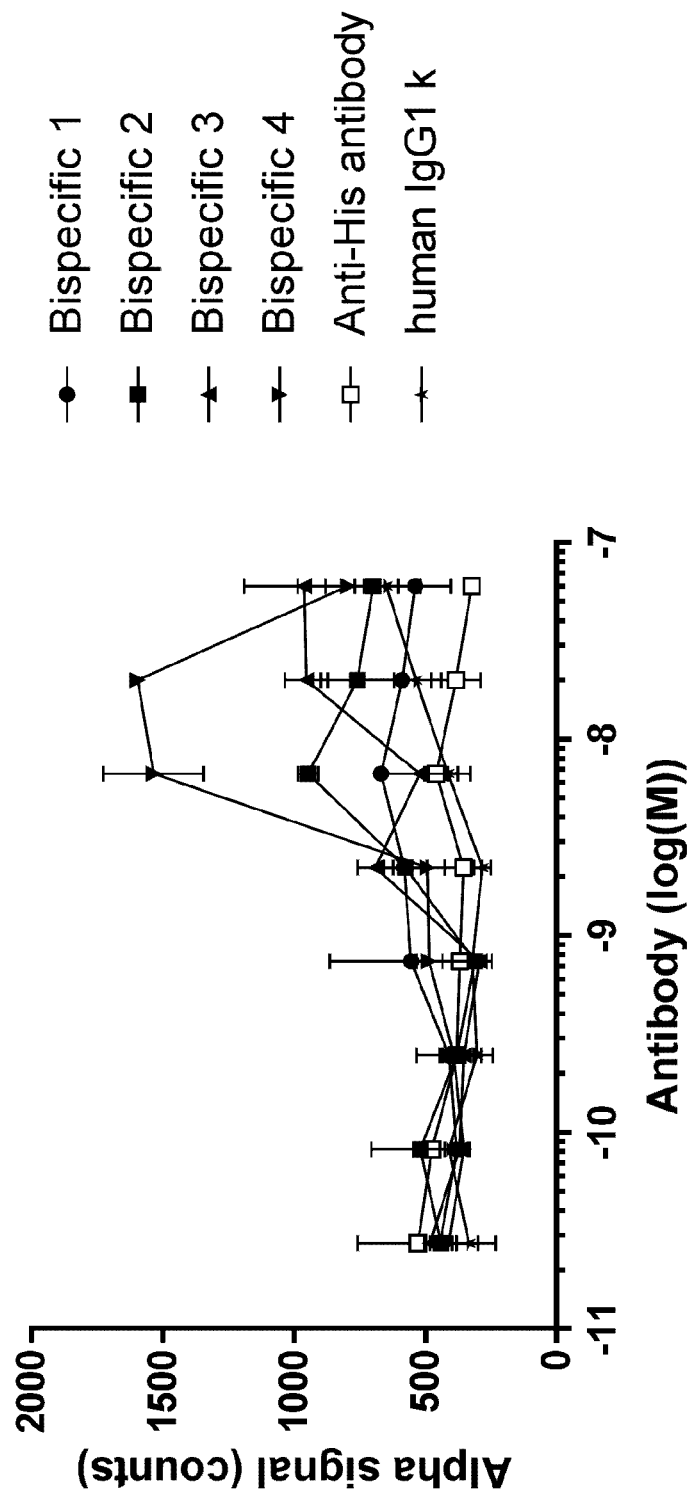
FIG. 26: Titration of FIT-Ig molecules, parental monospecific antibodies, and control antibodies in PD-L1/TIGIT AlphaScreen® Binding Assay using method two. AlphaScreen® donor and acceptor beads were coated for an hour with PD-L1 and TIGIT proteins respectively before the addition of antibodies for an hour followed by the detection of fluorescence. A) Titration of FIT-Ig molecules; B) Titration of monospecific antibodies. Data shown are representative of one unique experiment
Figure 26B:
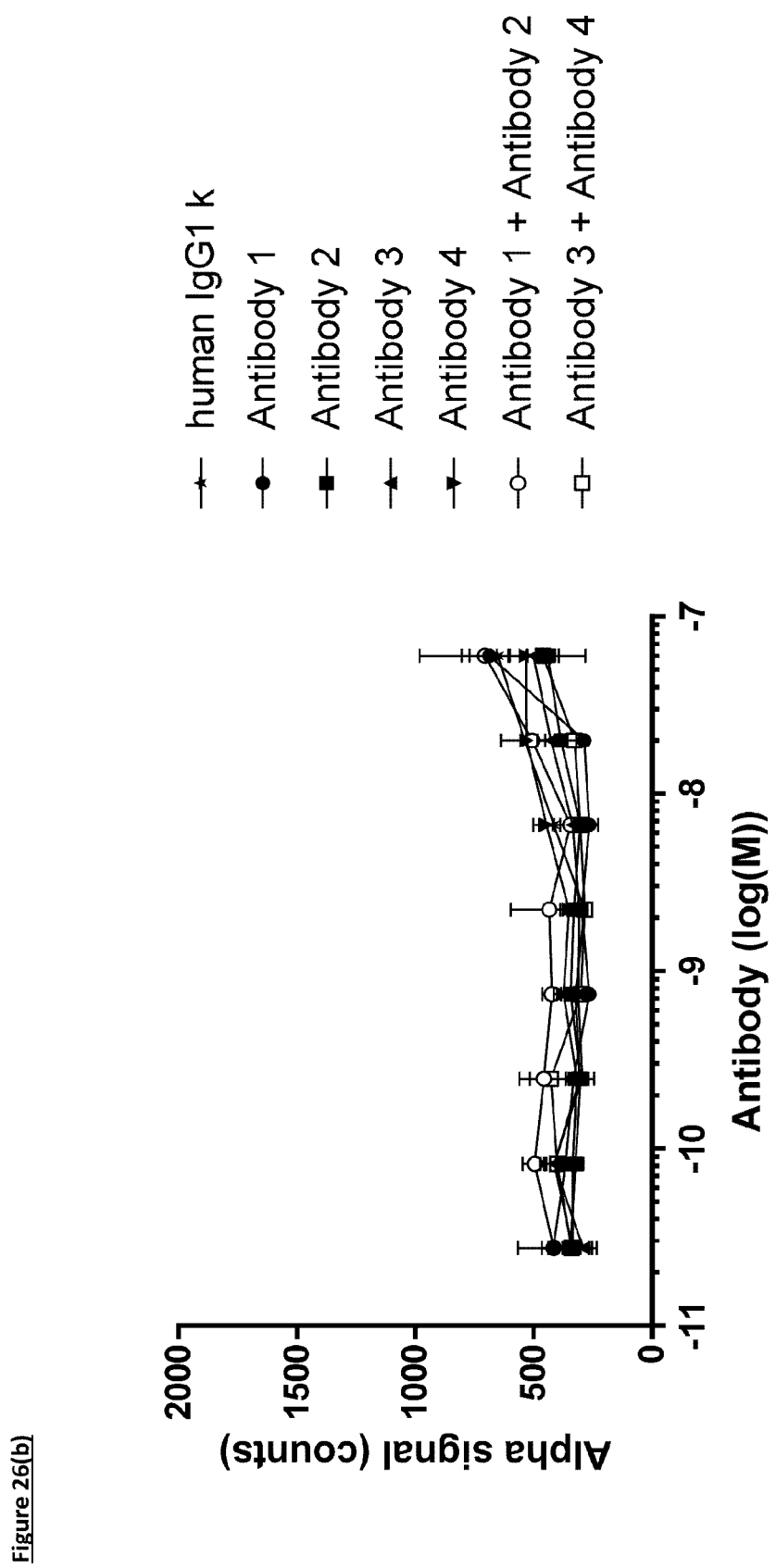

Bispecific antibodies, parental monospecific antibodies, alone and combined, and control antibodies were prepared in buffer at 300 nM and diluted as per 1:3 series, 8 points. 5 µL of each serial dilution of antibody were mixed in a 384-well AlphaLISA® assay plate (Perkin Elmer 6005350) to 10 µL of pre-coated donor beads and 10 µL of pre-coated acceptor beads. Assay plates were incubated at room temperature for 4 hours in the dark and then read as described for method one. The fluorescent counts measured (Alpha signal) were plotted in Prism against antibody titrations. Results are shown in FIG. 26. Binding of FIT-Ig molecules to PD-L1 and TIGIT increases with the concentration of antibody up to 20 nM. No binding is observed for the monospecific parental antibodies and the isotype control.

d) Characterisation of Bispecific FIT-Ig Molecules Binding to PD-L1 and TIGIT by Flow Cytometry A flow cytometry protocol was developed to assess the ability of the FIT-Ig molecules to promote the recruitment of cells expressing TIGIT and PD-L1. For this purpose, CHO cells transfected with human PD-L1 were stained with CellTrace™ Far Red (Invitrogen C34572) which emits maximally at 661 nm while HEK cells transfected with human TIGIT were stained with CellTrace™ Violet (Invitrogen C34571) which emits maximally at 450 nm.

CHO human PD-L1 and HEK human TIGIT cells were harvested, counted, washed, and re-suspended in PBS (Gibco 14190169) at 1 million of cells per mL. CellTrace™ Far Red and CellTrace™ Violet dyes were diluted 1:2000 and incubated with cells for 20 min at 37° C. in the dark, according to manufacturer's recommendations. Buffer (PBS (Gibco 14190169), 1% BSA (Sigma) 0.1% Na azide (Severn Biotech 40-2010-01)) was then added in excess for an additional 5-minute incubation step. Cells were spun down, re-suspended in buffer at 0.5 million of cells per mL and incubated for at least 10 minutes at 37° C. before proceeding with binding protocol. Unstained cells were kept and used to set up the gating strategy.

Bispecific antibodies and human IgG1 were prepared in buffer at 150 nM and diluted as per 1:3 series, 8 points. 50 µL of each serial dilution of antibody, 50 µL of CHO human PD-L1 cells labelled with CellTrace™ Far Red and 50 µL of HEK human TIGIT labelled with CellTrace™ Violet were added to a 96-well, V-bottom PS plate (Greiner 651901). Assay plates were incubated at room temperature for 1 hour under gentle agitation (450 rpm) before being read using the Attune NxT flow cytometer (Thermo Fisher). CellTrace™ Violet was excited using the Violet laser and detected in the VL1 channel with a 440/50 bandpass filter. CellTrace™ Far Red was excited using the Red laser and detected in the RL1 channel with a 670/14 bandpass filter. Sample collection was performed without vortexing samples. FCS files were analysed with FlowJo® software. Single cells and duplets were gated based on the forward and side scatter dot plot.

Figure 27:
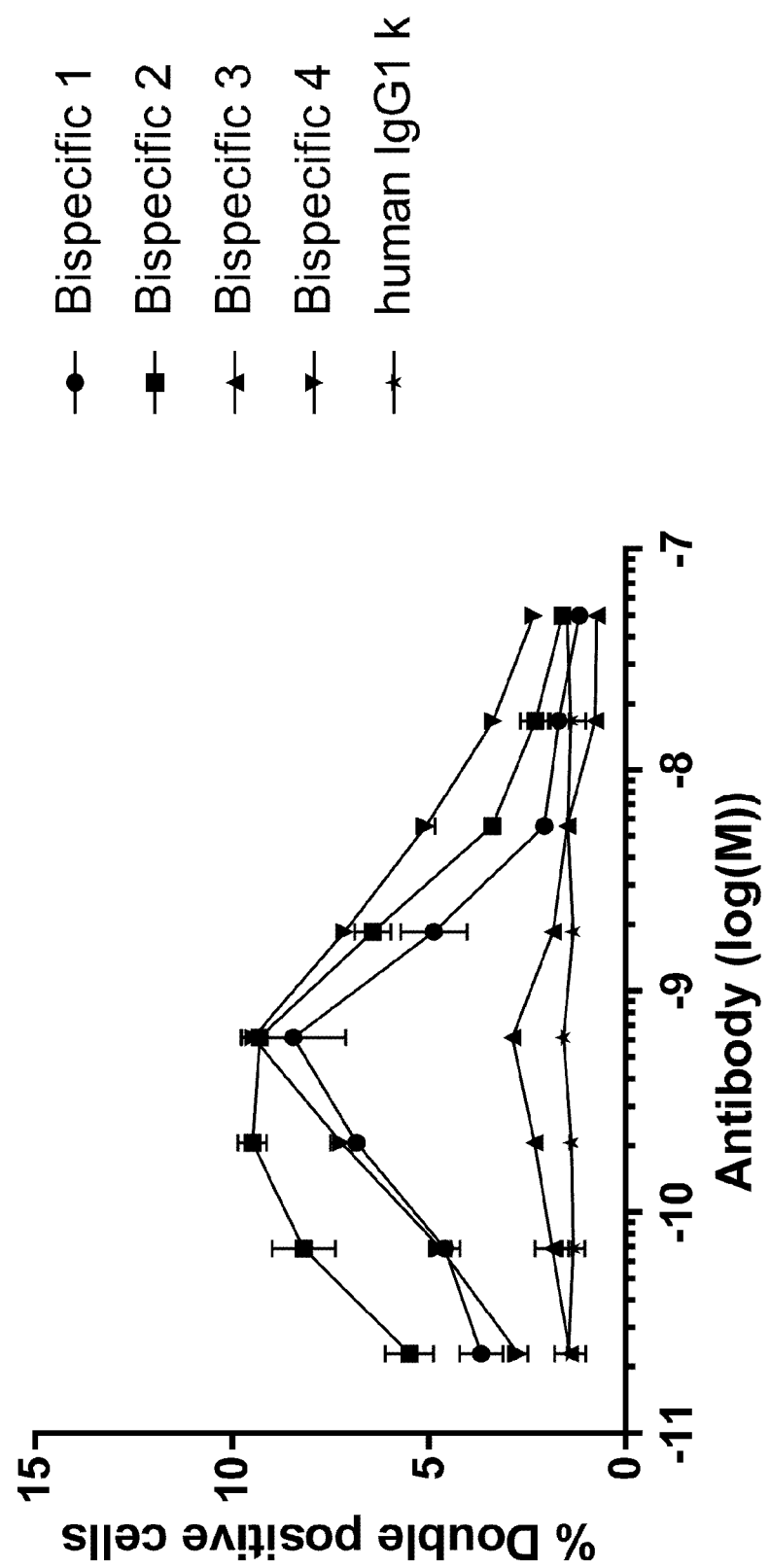
FIG. 27: Titration of FIT-Ig molecules, and control antibody in a PD-L1/TIGIT cell recruitment assay by flow cytometry. CHO human PD-L1 and HEK human TIGIT were stained with CellTrace™ Far Red and CellTrace™ Violet respectively and co-cultured in presence of antibodies for an hour prior to the detection of fluorescence and identification of double positive population. Data shown are representative of one unique experiment

Data analysis resulted in the identification of four different gates: a double negative quadrant corresponding to unstained CHO human PD-L1 and unstained HEK human TIGIT; two quadrants positive for single staining (in VL1 or RL1 channel); and a quadrant positive for dual staining (in both VL1 and RL1 channels) composed of stained CHO human PD-L1 and stained HEK human TIGIT recruited by FIT-Ig molecules. Percentages of double positive cells were plotted into Prism against antibody titrations. Results are shown in FIG. 27. Percentage of double positive cells increases with the concentration of FIT-Ig molecules up to 1 nM.

The monospecific binding of test molecules to target was confirmed on stained cells using monospecific antibodies labelled with R-Phycoerythrin (PE) which emits maximally at 590 nm. PE-labelled Antibody 1, Antibody 2 and human IgG1 were diluted in buffer at 150 nM. 50 µL of each antibody were mixed with 50 µL of stained CHO human PD-L1 and 50 µL of stained HEK human TIGIT in a 96-well, V-bottom PS plate (Greiner 651901). Following a 1 hour incubation at room temperature, cells were washed 3 times with 200 µL/well of PBS and re-suspended in 150 µL/well of buffer. Assay plates were read using the Attune NxT flow cytometer (Thermo Fisher) to record fluorescence. Cell Trace™ Violet and Far Red were detected as stated above. PE was excited using the Yellow laser and detected in the YL1 channel with a 585/16 bandpass filter. GeoMean values in the YL1 channel were used to determine monospecific binding to stained CHO human PD-L1 or stained HEK human TIGIT.

Example 11—Generation and Expression of Anti-PD-L1-IL-2 Immunocytokine Constructs Immunocytokines were generated by fusing wild type IL-2 (SEQ ID No:301), or IL-2 containing deletions in the first nine amino acids (see SEQ ID Nos:303 to 323, fused to Seq ID No:324), to the light chain of anti-PD-L1 antibody 1D05 (see Seq ID No:45). These were paired with an IgG1 effector-disabled variant of 1D05 heavy chain (Seq ID No:205). Wild type IL-2 fused to the heavy chain of 1D05 was generated for use as a control (SEQ ID No:302) and paired with the unmodified light chain of 1D05 (Seq ID No:45). Twenty-two immunocytokines were successfully expressed and characterised further. One light chain construct, 1D05 D1 did not express successfully.

Materials and Methods

The DNA sequences encoding the anti-PD-L1 (antibody 1D05) immunocytokine (C-terminal IL-2 fusion to light chain) were purchased as synthetic DNA strings and cloned into the pTT5 expression vector using the Golden Gate cloning strategy. The heavy chain sequence of 1D05, includes a constant region which is a disabled IgG1 variant with changes from wild-type shown in bold (Seq ID No:299). The light chain of antibody 1D05 has full length wild type IL-2 sequence (underlined) fused to the C-terminus of the Kappa constant region (Seq ID No:300). Overlap PCR using appropriate oligonucleotide primers were used to generate variants of N-terminal of IL-2 (see Seq ID No:300 where IL-2 the sequence is underlined and the region to be varied is shown in bold). Variant sequences were cloned into the pTT5 expression vector using the Golden Gate method. The wild type and variant constructs were transfected to Expi293™ cells for expression.

Example 12—Generation of IL-2R Transfectant Cells for Screening

In order to differentiate between immunocytokine activity on the high affinity ($\alpha\beta\gamma$) and intermediate affinity ($\beta\gamma$) IL-2 receptors, IL-2R transfectants were generated. TF-1 cells, expressing endogenous common $\gamma$ chain, were transfected with $\beta$, or $\alpha$ and $\beta$ receptor subunits, to impart responsiveness to IL-2. The proliferative response to immunocytokines was then analysed using these cells (see Example 13).

Materials and Methods

Two recombinant cell lines were generated to distinguish between signalling through high affinity ($\alpha\beta\gamma$) and intermediate affinity ($\beta\gamma$) IL-2R. The erythroleukemia cell line TF-1 (European Collection of Authenticated Cell Cultures) shows complete growth dependency on granulocyte-macrophage colony-stimulating factor (GM-CSF) or interleukin-3 (IL-3). The first cell line generated was transfected with full length human IL-2R$\beta$ (CD122) only. The second cell line was generated by transfecting the full length human IL-2R$\alpha$ (CD25) into the first cell line.

The transfected sequences were codon optimized for mammalian expression and cloned into an expression vector under the CMV promoter flanked by 3' and 5' piggyBac specific terminal repeat sequences facilitating stable integration into the cell genome (see: "A hyperactive piggyBac transposase for mammalian applications"; Yusa K., et al., Proc. Natl. Acad. Sci. USA., 108(4): 1531-6, 2011 Jan. 25). Furthermore, the expression vector for each subunit contained a different selection cassette to facilitate stable cell line generation. The $\beta$ subunit was selected using puromycin (Sigma) and the $\alpha$ subunit using geneticin (Gibco). The $\alpha$ subunit was transfected into cells already expressing the $\beta$ subunit.

The expression plasmids were co-transfected with a plasmid encoding piggyBac transposase into the TF1 cell line by electroporation using the Lonza 4-D nucleofector transfection X kit system according to manufacturer instructions. 24 hours after transfection, complete media was supplemented with the appropriate selection and cells grown for at least 3 weeks to select a stable line, with media being exchanged every 3 to 4 days. The expression of the recombinant human subunits was assessed by flow cytometry using anti-human CD122 (IL-2R$\beta$) APC conjugated antibody (eBioscience) and anti-human CD25 (IL-2Ra) PE conjugated antibody (eBioscience). Endogenous common $\gamma$ chain expression was confirmed with anti-human CD132 (common $\gamma$ chain) PE conjugated antibody (eBioscience). As expression was low, CD122$^+$ cells were sorted by fluorescence activated cell sorting (FACS) and further cultured under selection. There was uniform expression of a chain after transfection, and therefore these cells were not sorted.

Complete TF1 media was made up of RPMI medium 1640 (Gibco) plus GM-CSF (2 ng/mL) and supplemented with 10% v/v heat inactivated fetal bovine serum (hiFBS, Gibco). Once responsiveness to IL-2 was confirmed, transfected cell lines were maintained in RPMI 1640, 10% hiFBS and 5 ng/mL recombinant human IL-2 with (op) or without (p) geneticin.

Figure 12A:
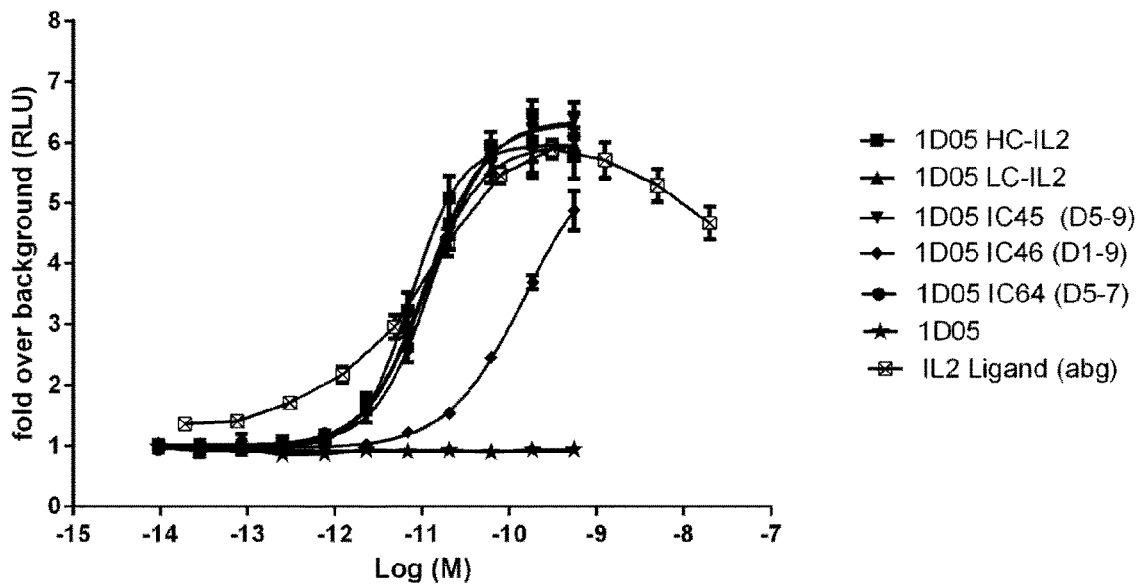
FIG. 12(a): Ability of immunocytokine constructs to induce proliferation in IL-2Rαβγ expressing TF-1 cells, compared with equimolar concentrations of free IL-2. Data shown is from a single experiment, representative of three experiments
Figure 12A:
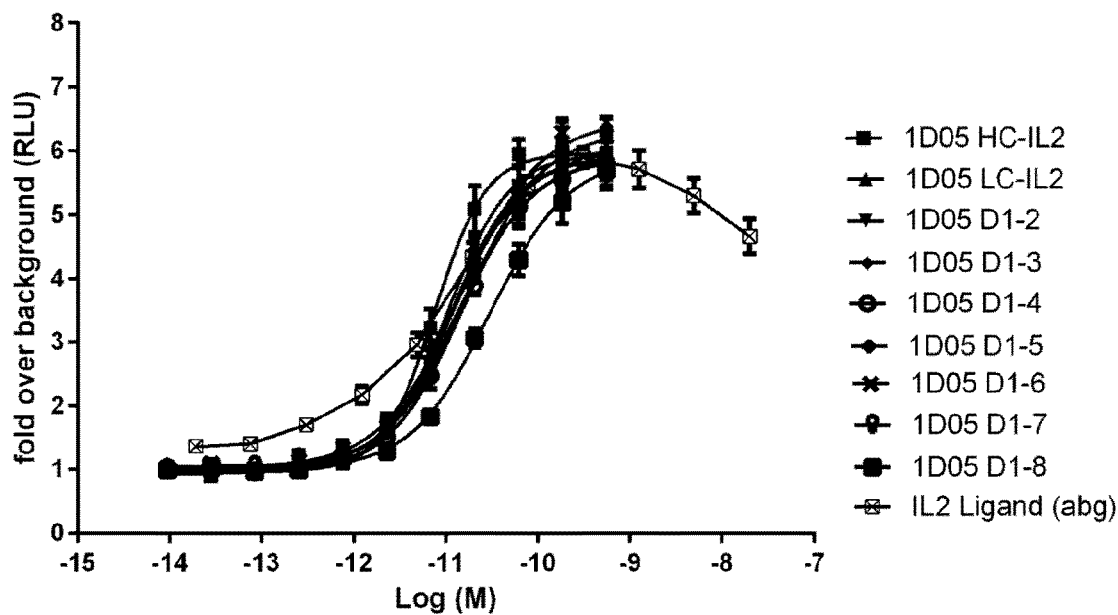
Figure 12A:
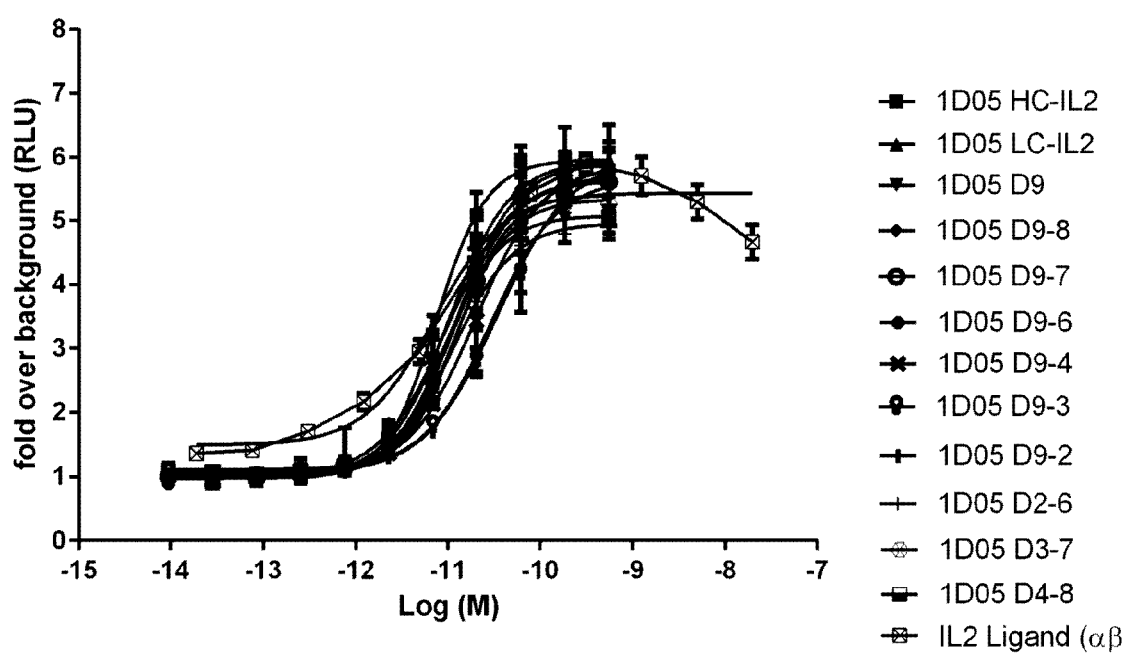
Figure 12B:
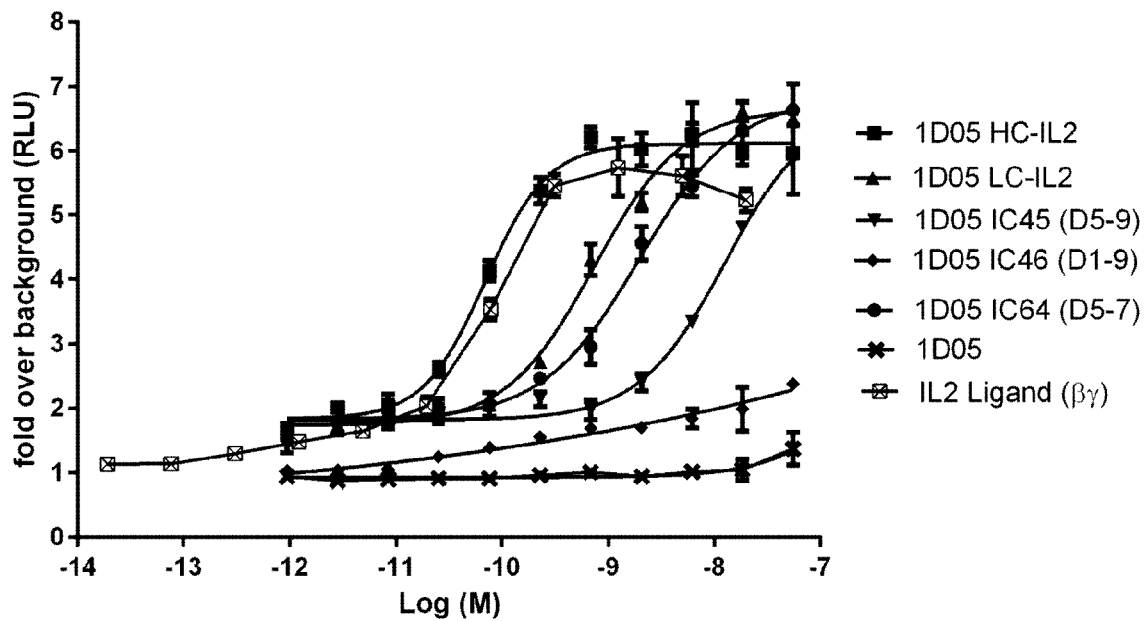
FIG. 12(b): Ability of immunocytokine constructs to induce proliferation in IL-2Rβγ expressing TF-1 cells, compared with equimolar concentrations of free IL-2. Data shown is from a single experiment, representative of four experiments
Figure 12B:
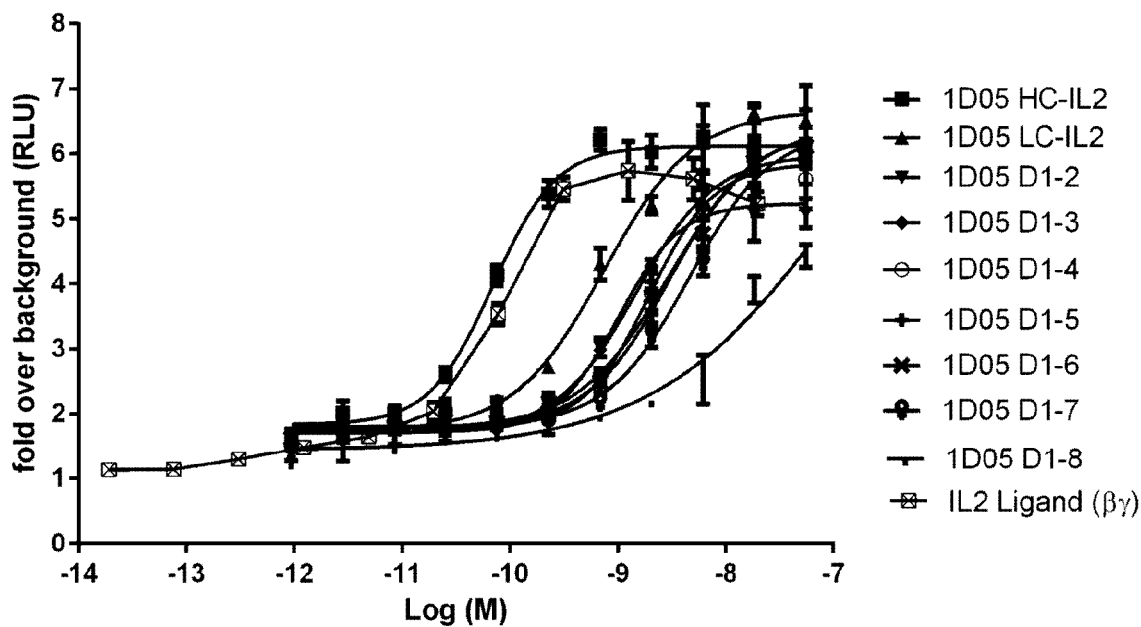
Figure 12B:
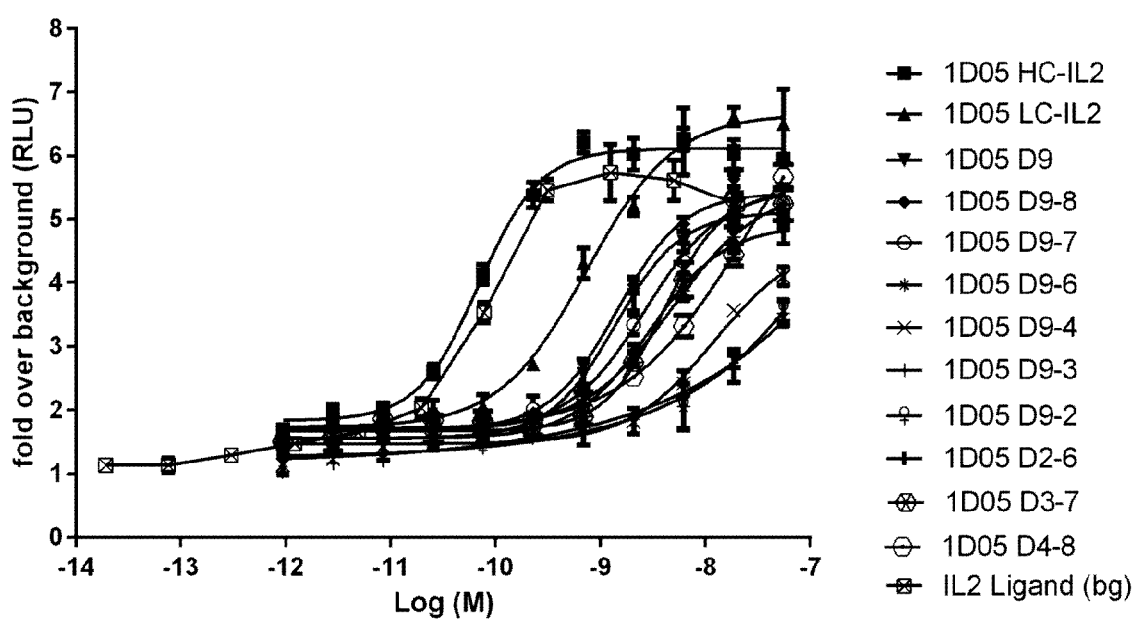

Example 13—Assessing Ability of Immunocytokine Constructs to Signal Through IL-2R Immunocytokines were assessed for their ability to induce proliferation of TF1 cell lines transfected with the $\beta$ subunit, or with both the α and β subunits of IL-2R. Cells were starved of cytokines overnight, then stimulated with titrations of each immunocytokine. CellTiter-Glo® was used to determine the number of viable cells in culture after 3 days, based on quantitation of the ATP present. There was a broad range of activities of the immunocytokines on IL-2Rβγ, with the largest IL-2 deletions having the greatest reduction on proliferation, compared with equimolar amounts of free IL-2. The effect on αβγ activity is not as pronounced, but again the greatest reduction in proliferation is seen with the largest IL-2 deletions. Deletions in the first few N-terminal amino acids of IL-2 allow for fine tuning of cytokine activity. A representative experiment is shown in FIGS. 12(a) and (b).

Materials and Methods

IL-2R transfected TF1 cells were routinely cultured in RPMI+10% fetal bovine serum (culture medium) with the addition of IL-2 (Peprotech) at 5 ng/mL for the β transfected cell line and IL-2 at 5 ng/mL and Geneticin (Gibco) at 350 µg/mL for the αβγ transfected cell line. Prior to testing of immunocytokine constructs, the cells were harvested by centrifugation and aspirated to remove the supernatant. The cells were washed in PBS to remove cytokines and antibiotics. Cells were resuspended in fresh culture medium at $10^5$ cells/mL, without supplements and returned to the incubator overnight.

The cells were harvested by centrifugation and aspirated to remove the supernatant. Cells were resuspended in complete medium and 30 µL of cell solution was added to the plate (white walled tissue culture treated 384-well plate) wells to achieve an initial cell concentration of 1250 cells/well.

The IL-2 ligand was prepared as serial four-fold dilutions from 300 ng/mL final assay concentration (FAC) (600 ng/mL working) in culture media. The immunocytokine constructs were titrated from 0.1 µg/mL (three-fold dilutions) for testing on the αβγ cell line and 10 µg/mL (three-fold dilutions) for the βγ cell line. 30 µL of titrations were added to the cell plate. To control wells, 30 µL of culture media without IL-2 was added. To reduce evaporation effects, the outermost rows/columns of the plate were filled with 80 µL of culture media. The plates were then incubated for 3 days at 37° C., 5% $CO_2$. Following the culture period proliferation of TF-1 cells was assessed by addition of 30 µL of Cell Titre Glo (Promega) to all wells. The plate was incubated at room temperature for 10 minutes then read using ultrasensitive luminescence filter.

Calculation of fold over background from TF-1 proliferation assay $$\text{fold over background} = \frac{\text{sample } RLU}{\text{mean over background } RLU} \quad \text{Equation 7}$$

RLU = relative luminescence units
Data expressed as fold over background.
Background was defined as wells containing cells but no cytokine Example 14—Binding of Immunocytokines to PD-L1

Surface plasmon resonance was used to confirm the ability of the immunocytokine constructs to bind PD-L1. The presence of the IL-2 on the light chain does not have any detrimental effect on binding (Table 9). Four constructs with a range of IL-2 activities were shortlisted for further characterisation—these were 1D05 D1-9 ICK, 1D05 D1-8 ICK, 1D05 D9-2 ICK and 1D05 D9-7 ICK.

TABLE 9

Affinity of 1D05 binding to PD-L1 is unaffected by the fusion of IL-2 to the antibody, as measured by surface plasmon resonance. Data shown is from a single experiment

| Sample Name | KD (nM) |
| --- | --- |
| 1D05 | 0.171 |
| 1D05 HC-IL2 | 0.240 |
| 1D05 LC-IL2 | 0.207 |
| 1D05 IC45 (D5-9) | 0.203 |
| 1D05 IC46 (D1-9) | 0.195 |
| 1D05 IC64 (D5-7) | 0.214 |
| 1D05 D1-2 | 0.187 |
| 1D05 D1-3 | 0.199 |
| 1D05 D1-4 | 0.186 |
| 1D05 D1-5 | 0.203 |
| 1D05 D1-6 | 0.211 |
| 1D05 D1-7 | 0.178 |
| 1D05 D1-8 | 0.190 |
| 1D05 D9 | 0.205 |
| 1D05 D9-8 | 0.225 |
| 1D05 D9-7 | 0.200 |
| 1D05 D9-6 | 0.211 |
| 1D05 D9-4 | 0.175 |
| 1D05 D9-3 | 0.171 |
| 1D05 D9-2 | 0.189 |
| 1D05 D2-6 | 0.201 |
| 1D05 D3-7 | 0.203 |
| 1D05 D4-8 | 0.208 |
| benchmark | 0.099 |

Materials and Methods

Analysis of Immunocytokines by Surface Plasmon Resonance

Label-free surface plasmon resonance (SPR) analysis was carried out on the ProteOn XPR36 (BioRad) array SPR machine. An anti-human IgG capture surface was created on a GLC biosensor chip using amine coupling of an anti-human IgG from GE Healthcare. Test antibodies were captured on this surface and human PD-L1 (in-house) was used as the analyte at 64 nM, 16 nM, 4 nM, 1 nM and 0.25 nM. The assay was carried out at 25° C. using HBS-EP (Teknova H8022). Buffer alone was used to reference the binding sensorgrams. The data was analysed using the 1:1 model inherent to the ProteOn XPR36 analysis software.

Example 15—Assessing Capacity of Immunocytokines to Neutralise the Interaction of PD-L1 and PD-1/CD80

Figure 13A:
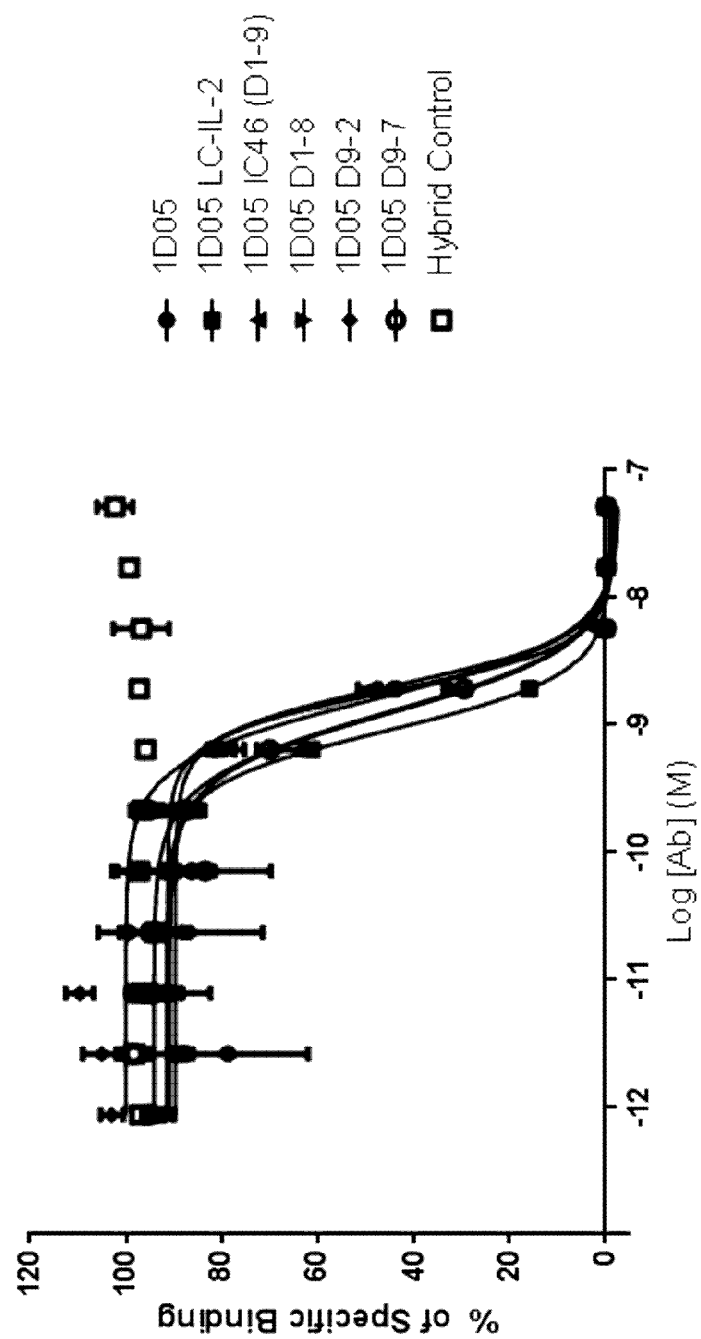
FIG. 13(a): Capacity of 1D05 antibody to neutralise the interaction between PD-1 and PD-L1 is unaffected by the fusion of IL-2 to the antibody, as measured in a neutralisation ELISA. Data shown is from a single experiment, representative of three experiments
Figure 13B:
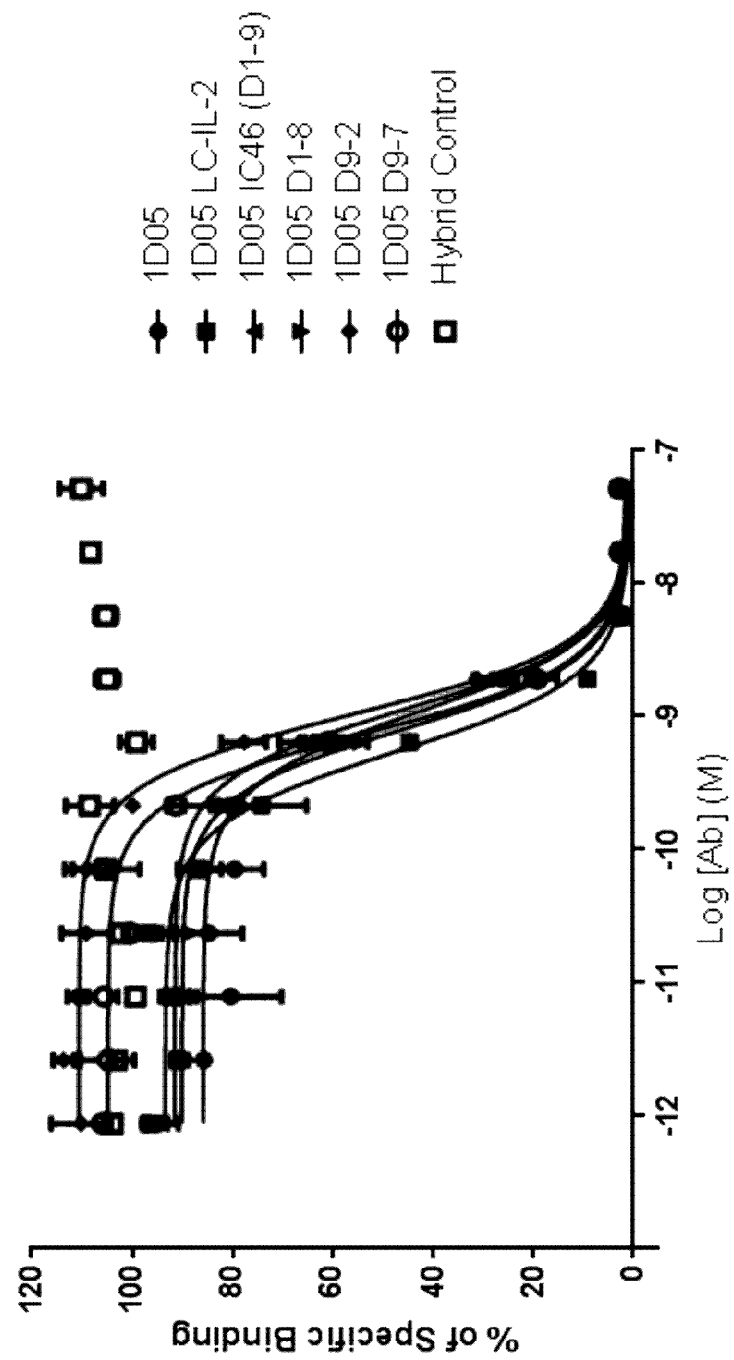
FIG. 13(b): Capacity of 1D05 antibody to neutralise the interaction between CD80 and PD-L1 is unaffected by the fusion of IL-2 to the antibody, as measured in a neutralisation ELISA. Data shown is from a single experiment, representative of three experiments

To ensure that fusion of the IL-2 molecule to the antibody did not disrupt its neutralisation capacity, shortlisted immunocytokines were tested in a neutralisation ELISA. The shortlisted immunocytokines tested did not differ from wild type antibody in their ability to neutralise interactions between PD-L1 and PD-1, and PD-L1 and CD80. Results are shown in FIG. 13 and Table 10. Values in the table are the means of three independent experiments.

TABLE 10

Summary of neutralisation ELISA data, expressed as mean of three independent experiments

| Clone | PD1-PD-L1 Neutralisation IC$_{50}$ (nM) | CD80-PD-L1 Neutralisation IC$_{50}$ (nM) |
|---|---|---|
| 1D05 | 1.41 | 0.882 |
| 1D05 LC-IL-2 | 0.833 | 0.505 |
| 1D05 IC46 (D1-9) | 1.75 | 1.07 |
| 1D05 D1-8 | 1.16 | 0.745 |
| 1D05 D9-2 | 1.55 | 0.947 |
| 1D05 D9-7 | 1.15 | 0.70 |
| Hybrid Control | N/A | N/A |

Materials and Methods a) PD-L1/PD-1 or PD-L1/CD80 Neutralisation ELISA

CD80 (R&D Systems) or PD-1 (in house) diluted to 2.5 µg/mL were adsorbed to 96-well, low auto-fluorescent, high protein binding plates (Costar) overnight at 4° C. Excess protein was removed by washing with PBS-Tween (0.1% v/v) and the wells were blocked with 1% w/v bovine serum albumin (BSA, Sigma) in PBS for 1 hour at room temperature, after which plates were washed as described previously. 60 µL of a titration (three-fold dilutions from 100 nM) of antibody was added to a 96-well, non-binding plate diluted in ELISA assay buffer (PBS+0.1% BSA). 60 µL of biotinylated PD-L1 (in house, labelled with Lightning Link Biotinylation kit) at 16 nM working concentration (8 nM FAC) was added to the plate excluding control wells where 60 µL ELISA assay buffer was added. The plate was incubated for 30 min before transferring 50 µL to the coated plates.

The coated plates were incubated for 1 hour at room temperature. Excess protein was removed by washing with PBS-Tween (0.1% v/v). PD-L1 binding was detected using streptavidin labelled Europium (Perkin Elmer) diluted 1/1000 in DELFIA assay buffer (Perkin Elmer). The plates were washed with TBS (Tris buffered saline)-Tween (0.1% v/v) and 50 µL/well of DELFIA Enhancement solution (Perkin Elmer) was added to the plate. The time-resolved fluorescence was measured at 615 nm on an Envision plate reader (PerkinElmer). Percentage specific binding was calculated as defined in Equation 3.

IC$_{50}$ values were determined using GraphPad Prism software by curve fitting using a four-parameter logistic equation (Equation 4) from the percentage specific binding (Equation 3).

Example 16—De-Immunisation of Anti-PD-L1 Antibody

To reduce the possibility of adverse immunological reactions based around the anti-PD-L1-immunocytokine, a series of 1D05 antibody mutants (Seq ID Nos:47 to 51) was created with anticipated lower potential of immunogenicity, as determined by T-cell epitope analysis software. The mutations can be single or in combination. Mutants were assessed for their ability to bind PD-L1 with the same affinity as the wild-type molecule by SPR as described in Example 14, with the addition of human PD-L1 analyte at 256 nM. Mutations under investigation are included as Seq ID Nos:47 to 51, indicated by underlined and bold text. The V$_H$ framework mutations (Seq ID Nos:47 and 48) do not have any detrimental effects on binding. The V to A mutation in CDRH2 (Seq ID No:50) was detrimental to binding, and so an alternative mutation will be analysed (V to Y, Seq ID No:298). Results are shown in Table 11.

Example 17—Inhibition of Tumour Growth by an Anti-PD-L1 Antibody in NOD/SCID: Xenoaraft T-Cell Model Inhibition of melanoma tumour growth by lead antibody 1D05 in the hIgG1 LAGA (Seq ID No: 205) format was demonstrated in a NOD/SCID:xenograft T-cell model. T-cells were expanded in the presence of A375, a melanoma cell line, for 20 days in the presence of IL-2 and IL-7. T-cells were co-implanted subcutaneously with fresh A375 cells, then the antibody administered intraperitoneally after 1 hour. Tumour size and animal survival were monitored. Tumours in mice treated with antibody 1D05 were smaller than in animals treated with isotype control. Survival time in 1D05-treated mice was also increased.

Materials and Methods

Efficacy studies were performed using a T-cell/Xenograft model in NOD/SCID mice employing a refinement of the methods outlined in Stewart R et al. (Cancer Immunol. Res., 2015 September; 3(9):1052-62). Leukoreduction system chambers were obtained from NHSBT. HLA-A2 positive donors were selected by staining unfractionated blood using a PE-labelled anti-human HLA-A2 (Biolegend, Clone:

TABLE 11

Deimmunisation mutations to lead 1D05 antibody

| Heavy Chain | Light Chain | KD (nM) |
|---|---|---|
| 1D05 - IgG1 disabled (LAGA) Seq ID No: 299 | 1D05 kappa (Seq ID No: 45) | 0.29 |
| 1D05 V to A change in V$_H$ (Seq ID No: 47), IgG1 disabled (LAGA, Seq ID No: 205) | 1D05 kappa (Seq ID No: 45) | 0.33 |
| 1D05 F to S change in V$_H$ (Seq ID No: 48), IgG1 disabled (LAGA, Seq ID No: 205) | 1D05 kappa (Seq ID No: 45) | 0.23 |
| 1D05 V to A & F to S change in V$_H$ (Seq ID No: 342), IgG1 disabled (LAGA, Seq ID No: 205) | 1D05 kappa (Seq ID No: 45) | 0.23 |
| 1D05 - IgG1 disabled (LAGA) Seq ID No: 299 | 1D05 kappa, V to A change (Seq ID No: 50) | 2.66 |
| 1D05 V to A change in V$_H$ (Seq ID No: 47), IgG1 disabled (LAGA, Seq ID No: 205) | 1D05 kappa, V to A change (Seq ID No: 50) | 2.8 |
| 1D05 F to S change in V$_H$ (Seq ID No: 48), IgG1 disabled (LAGA, Seq ID No: 205) | 1D05 kappa, V to A change (Seq ID No: 50) | 1.94 |
| 1D05 V to A & F to S change in V$_H$ (Seq ID No: 342), IgG1 disabled (LAGA, Seq ID No: 205) | 1D05 kappa, V to A change (Seq ID No: 50) | 1.94 |

BB7.2), the red blood cells were then lysed, followed by fixation with 4% PFA, prior to acquisition on the Attune flow cytometer. PBMCs were isolated by density gradient centrifugation over Ficoll. Primary human CD4$^+$ and CD8$^+$ T-cells were then isolated using an EasySep human CD4$^+$ and CD8$^+$ T-cell enrichment kit (Stemcell Technologies, Cat 19052 and 19053). The CD4$^+$ and CD8$^+$ T-cells were then cultured separately for 20 days on a monolayer of mitomycin C treated A375 cells (at day 10, T-cells were re-plated on a fresh A375 monolayer) in the presence of recombinant human IL-2 and IL-7 (Peprotech). On day 20 the cells were frozen in 90% hiFBS/10% DMSO at −80° C. in a "Mr Frosty" (Nalgene) and stored in liquid nitrogen until required. The day before starting an in vivo experiment the cells were thawed and placed in culture.

On the day of implantation, the CD4+ and CD8+ T-cells were counted and mixed together in a 1:1 ratio. The CD4+/CD8+ mixture was then added to A375 tumour cells and injected subcutaneously into mice on the rear right flank. Treated groups received their first dose of antibody or isotype control (all dosed intraperitoneally at 10 mg/kg) one-hour post implantation of the cells. The animals received further doses 3, 6, 8 and 10 days post-implantation. Tumour development was monitored three times a week using digital calipers measuring in two dimensions until end of the study. Tumour volumes (mm$^3$) were estimated using a standard formula (L×W$^2$)/2 (with L being the larger diameter, and W the smaller diameter of the tumour). Mice were kept on studies until their tumours developed to a mean diameter of 12 mm or they reached one of the humane endpoints outlined in the study protocol. The humane endpoint survival statistics were calculated using the Kaplan-Meier method with Prism. This approach was used to determine if PD-L1 treatment was associated with improved survival.

TABLE 12

Treatment Groups

| Groups | Number of animals | Cell Line |
|---|---|---|
| 1 | 9 | 2 × 10$^6$ A375 Cells |
| 2 | 9 | 1:6 ratio T-cells: A375 Cells (2 × 10$^6$ A375 Cells) |
| 3 | 8 | 10 mg/kg isotype control hIgG1<br>1:6 ratio T-cells: A375 Cells (2 × 10$^6$ A375 Cells) |
| 4 | 8 | 10 mg/kg anti-PD-L1 1D05 hIgG1 LAGA (Seq ID No: 205)<br>1:6 ratio T-cells: A375 Cells (2 × 10$^6$ A375 Cells) |

Figure 14:
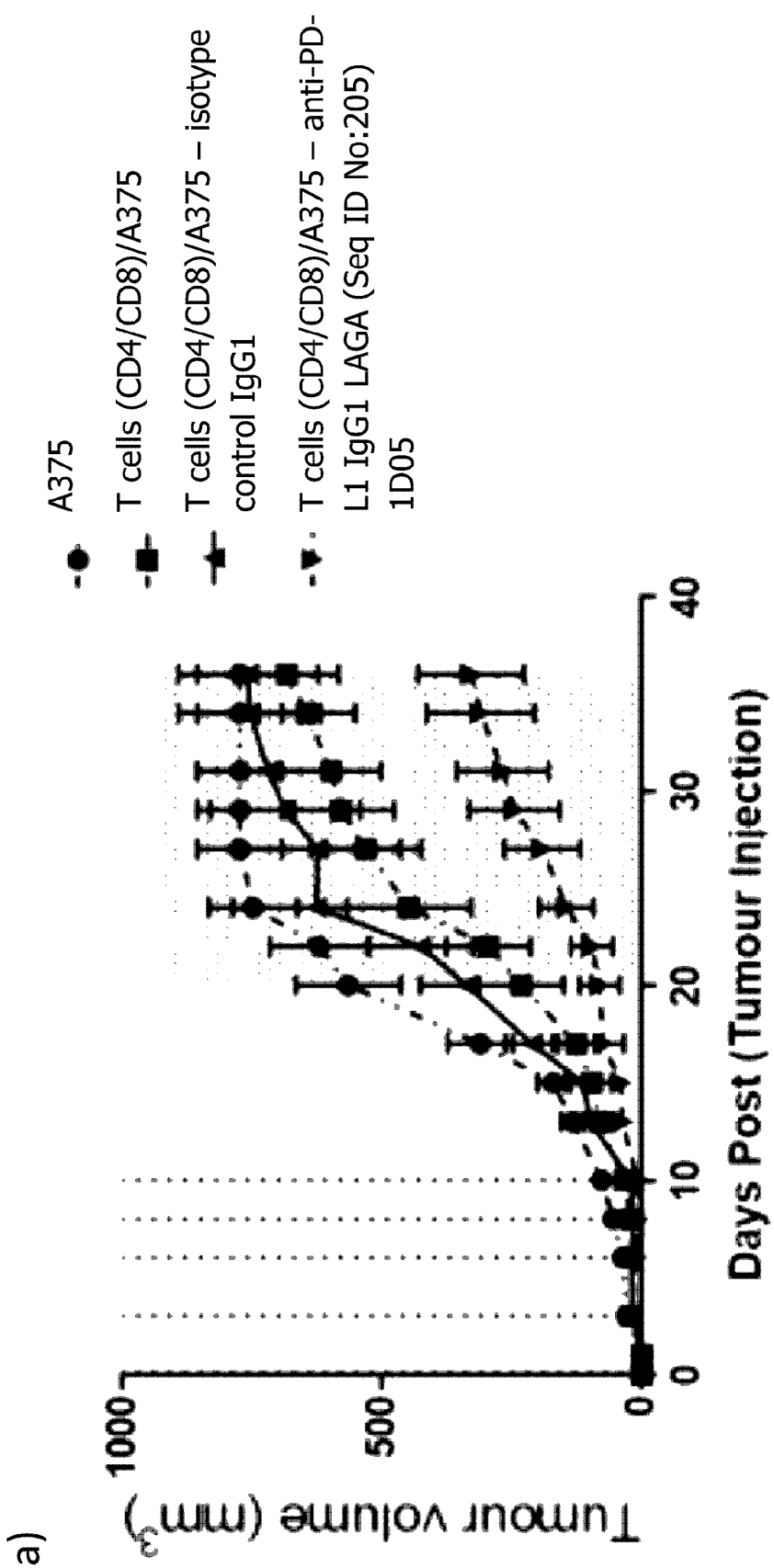
FIG. 14: Mean group and individual animal growth curves for the NOD/SCID: Xenograft in vivo efficacy study
Figure 14:
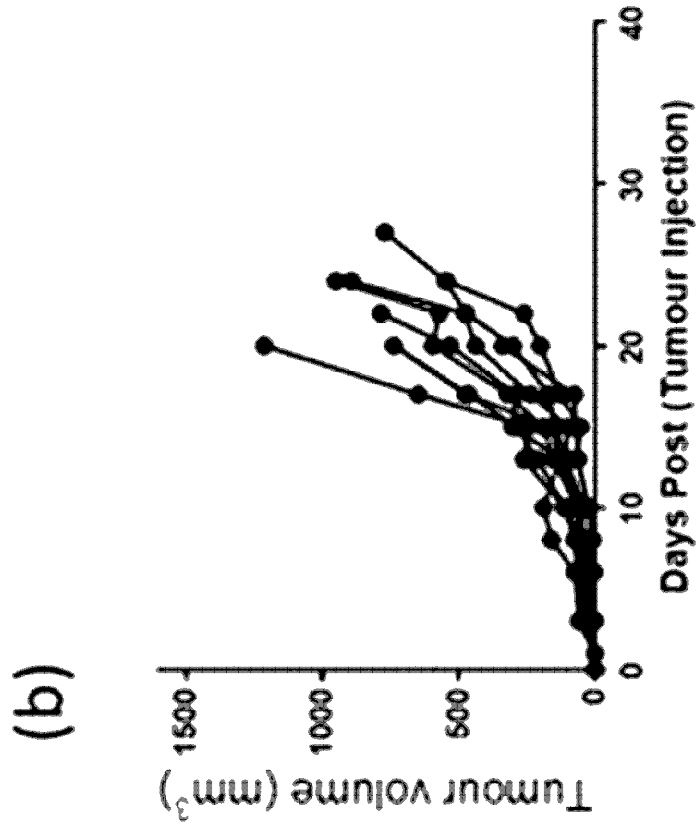
Figure 14:
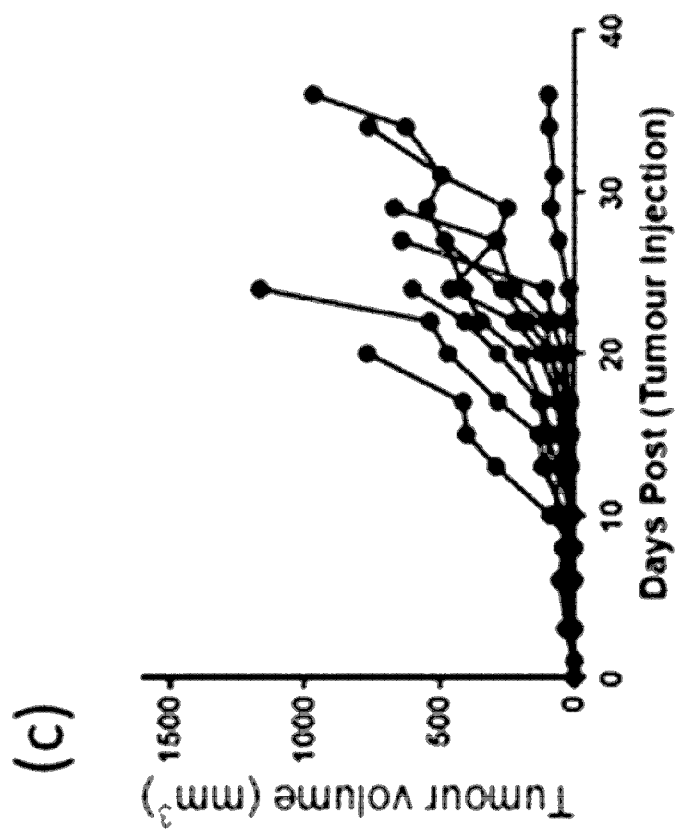
Figure 14:
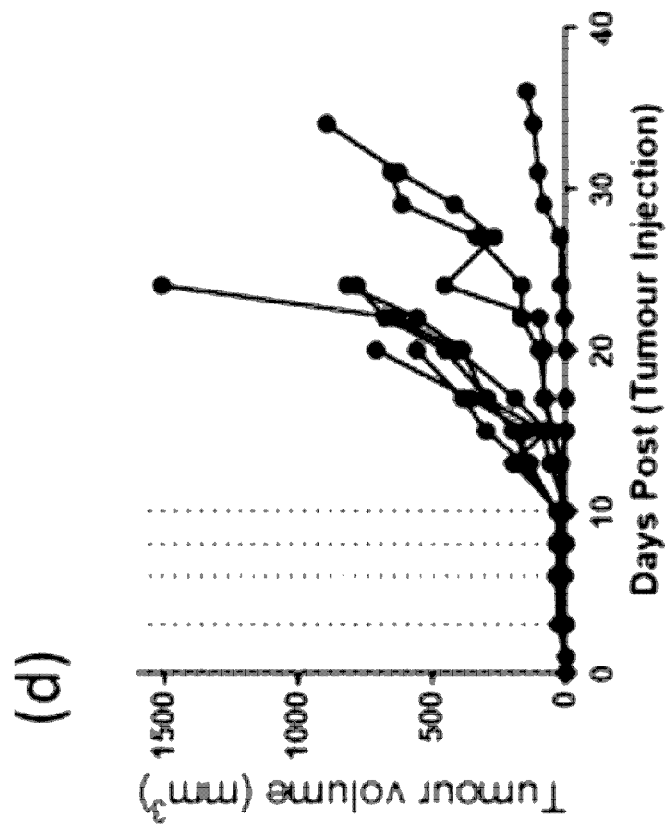
Figure 14:
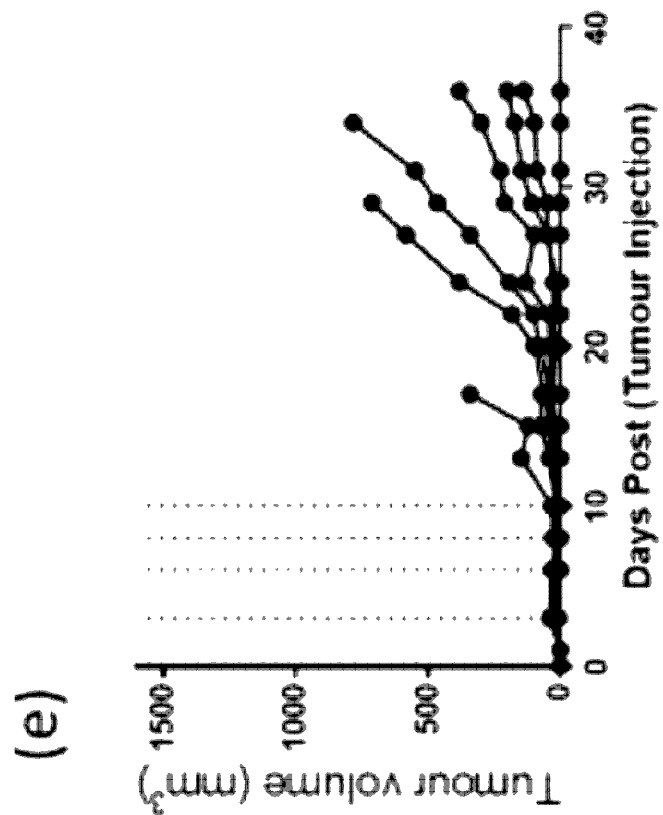

Treatment with the isotype control had no effect on tumour development when compared to the group where the CD4+/8+ T-cells are co-injected with the tumour cells. Whilst treatment with the anti-PDL1 antibody 1D05 delayed the tumour development when compared to the Isotype Control. This is shown in FIG. 14.

Figure 15:
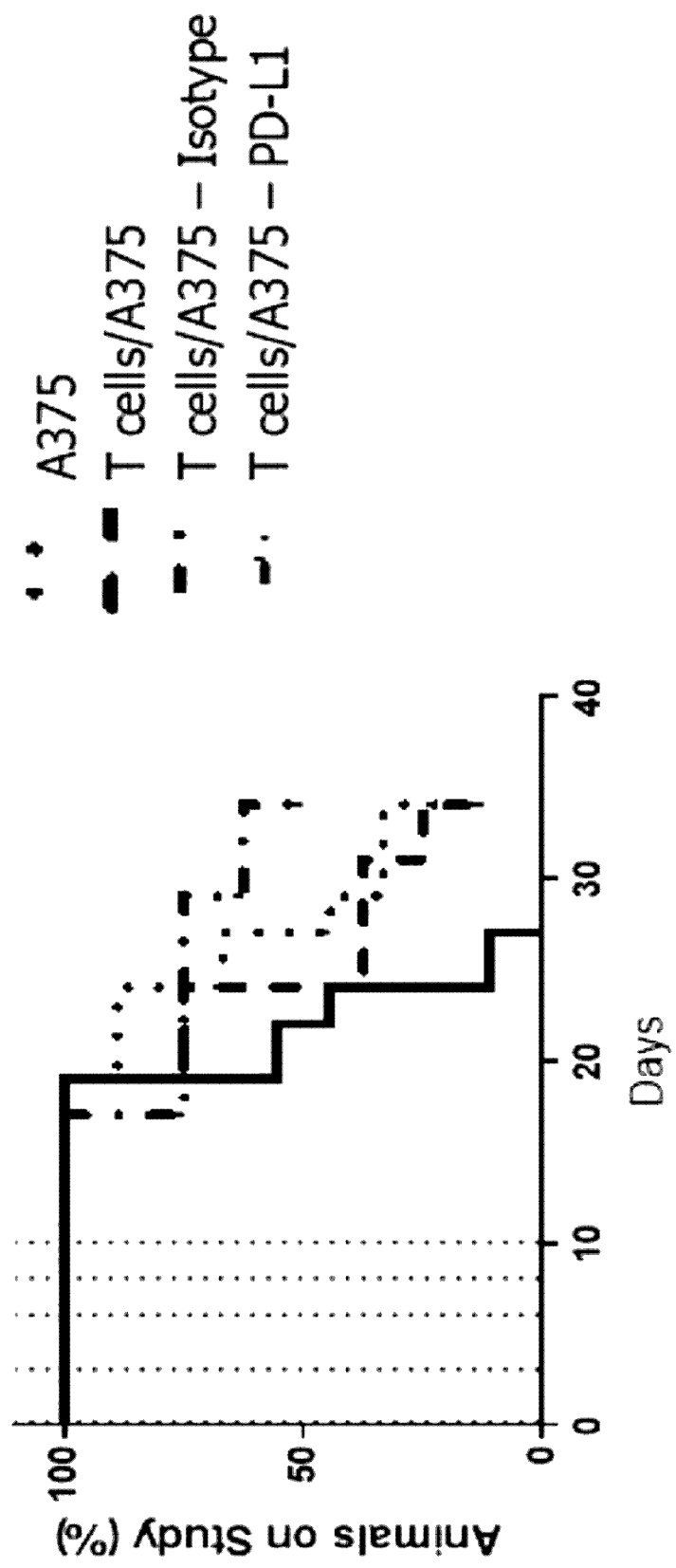
FIG. 15: Kaplan-Meier plot for the NOD/SCID:Xenograft in vivo efficacy study showing the number of animals still on study. This plot shows the slight increase in the time on study when CD4+/CD8+ T-cells are co-injected with the tumour cells (T-cells/A375) (n=9) when compared to the tumour cells alone A375 group (n=9). Treatment with the isotype control (T-cells/A375—Isotype (n=8)) had no effect on survival when compared to the T-cells co-injected with the tumour cells without antibody. Treatment with 10 mg/kg of the anti-PD-L1 antibody 1D05 (T-cells/A375-anti-PD-L1) (n=8)) significantly increased the time on study when compared to the isotype control group. Dosing was 1-hour post injection of the T-cells/tumour cells and on days 3, 6, 8 and 10, show on the graph by the dotted lines

All groups with T-cells co-injected with the tumours showed an increase in time on study when compared to the tumour alone group. Treatment with the isotype control had no effect on time on study, whilst treatment with the anti-PDL1 antibody 1D05 increased time on study when compared to all the other groups including the isotype control groups. Results are shown in FIG. 15.

Example 18: Single Dose Study of Immunocytokines in Cynomolgus Monkeys

To assess pharmacodynamic and pharmacokinetic (PK) parameters in the most relevant animal model, male cynomolgus monkeys received a single dose of immunocytokine (ICK) at 1 mg/kg. Animals were observed for clinical manifestations of toxicity, and blood samples were taken over the course of 7 days for the analysis of PK, production of cytokines and characterisation of leukocyte subsets. The in-life phase of the study, and haematology, flow cytometry and cytokine analysis was performed at Envigo UK (study number GF13YC). Pharmacokinetic analysis was performed in-house.

Materials and Methods

Male cynomolgus monkeys of at least 2 years of age were used for the study and body weights were recorded at 7 days and 4 days before the start of the study. Immunocytokine constructs were formulated in 50 mM sodium acetate pH 5.5, at 1 mg/mL and were diluted to 0.2 mg/mL in physiological saline for intravenous infusion at a rate of 5 mL/kg/hour. Blood pressure and body temperature were monitored pre-treatment, 1 hour and 4 hours post end-of-dose. Animals were observed twice daily for signs of ill-health. The study was performed in two phases—initial doses of 1D05 HC IL-2 ICK and 1D05 LC D9-7 ICK to ensure dose level and PK timepoints were suitable, then dosing of 1D05 LC D9-7 ICK was repeated, alongside four further constructs (see Table 1). Phase 2 dosing of 1D05 LC D9-7 ICK is indicated by a (2) next to the construct name.

TABLE 13

Treatment groups and animal numbers

| Phase | Animal | Test Item |
|---|---|---|
| 1 | 134 | 1D05 HC IL-2 ICK |
| 1 | 135 | 1D05 LC D9-7 ICK |
| 2 | 136 | 1D05 LC IL-2 ICK |
| 2 | 137 | 1D05 LC D9-7 ICK (2) |
| 2 | 138 | 1D05 LC D9-2 ICK |
| 2 | 139 | 1D05 LC D1-8 ICK |
| 2 | 140 | 1D05 LC D1-9 ICK |

Figure 16:
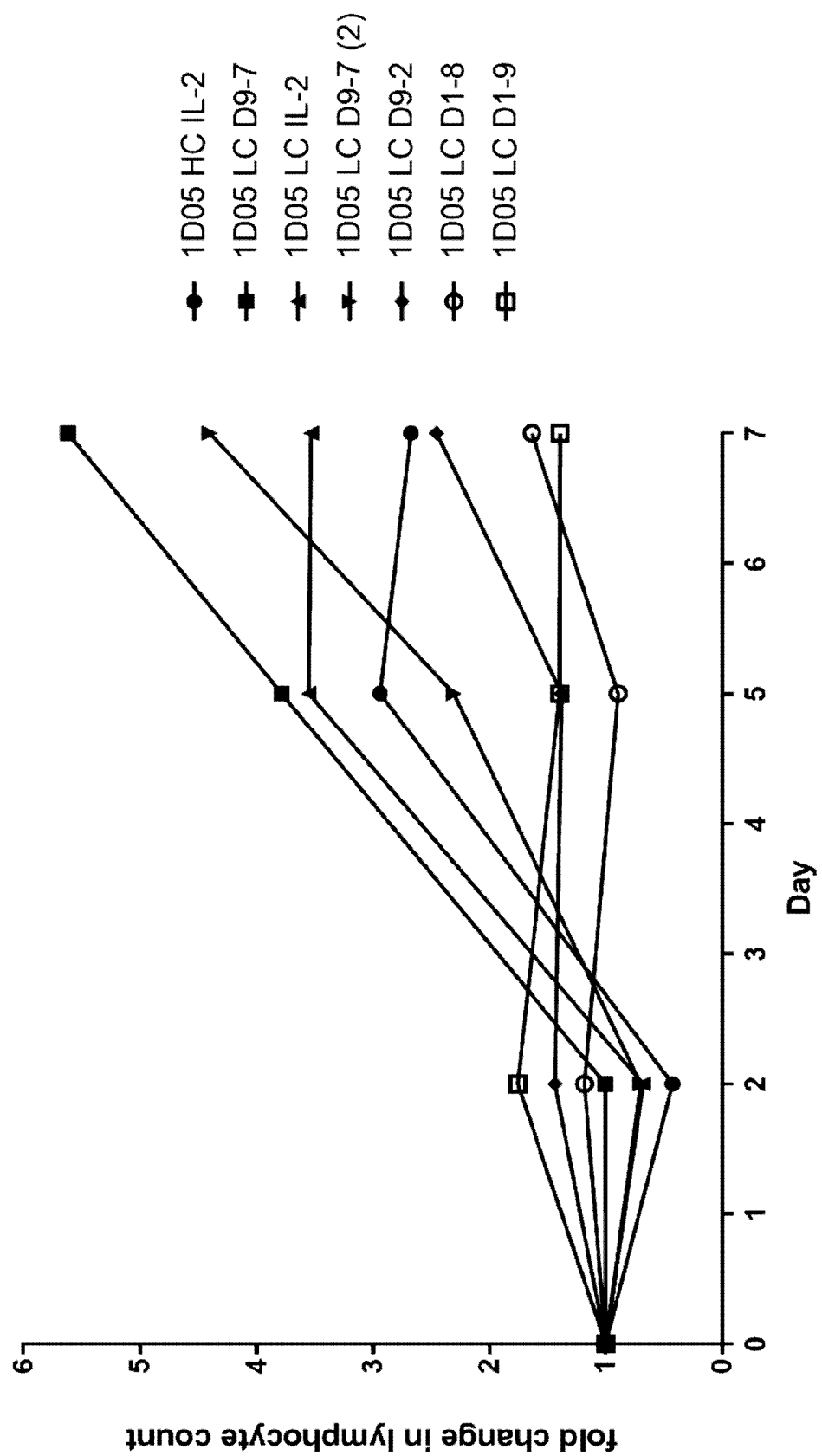
FIG. 16: Expansion of lymphocytes in response to dosing with immunocytokines. Fasting blood samples were taken into EDTA treated tubes pre-treatment (0), and 2, 5 and 7 days post-treatment. Cell counts were measured by the Bayer Advia 120. Results are expressed as fold change in lymphocyte count
Figure 17:
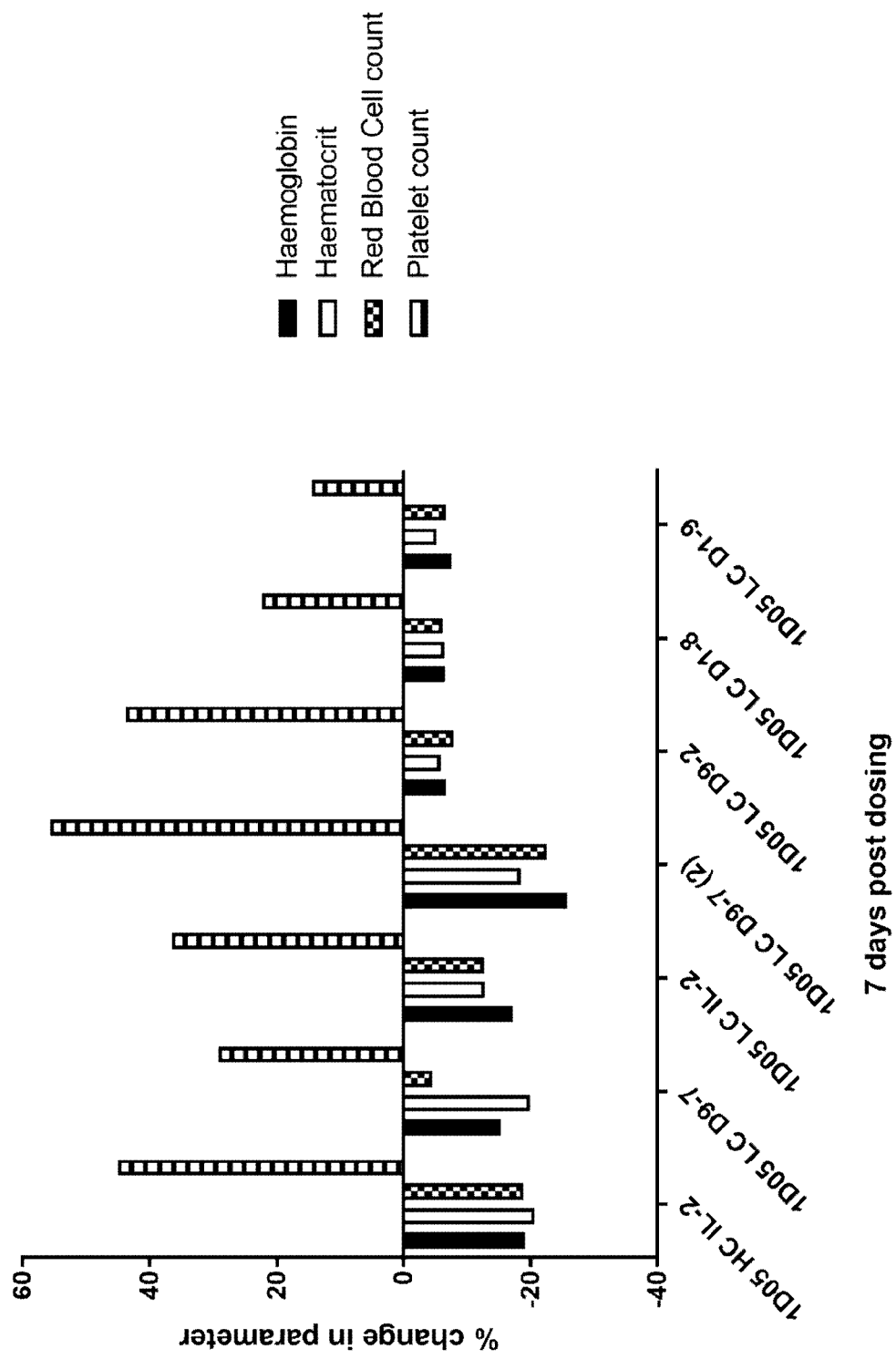
FIG. 17: Analysis of standard haematological parameters in response to dosing with immunocytokines. Fasting blood samples were taken into EDTA treated tubes pre-treatment and 7 days post-treatment. Analysis of haemoglobin, haematocrit, red blood cell counts and platelet counts were performed using the Bayer Advia 120. Results are expressed as the percentage change in parameter 7 days post-dosing

For haematological analysis, fasting blood samples were taken into EDTA treated tubes pre-treatment, and 2, 5 and 7 days post-treatment. Routine haematology parameters were measured by the Bayer Advia 120. Results are shown in FIGS. 16 and 17.

Figure 18:
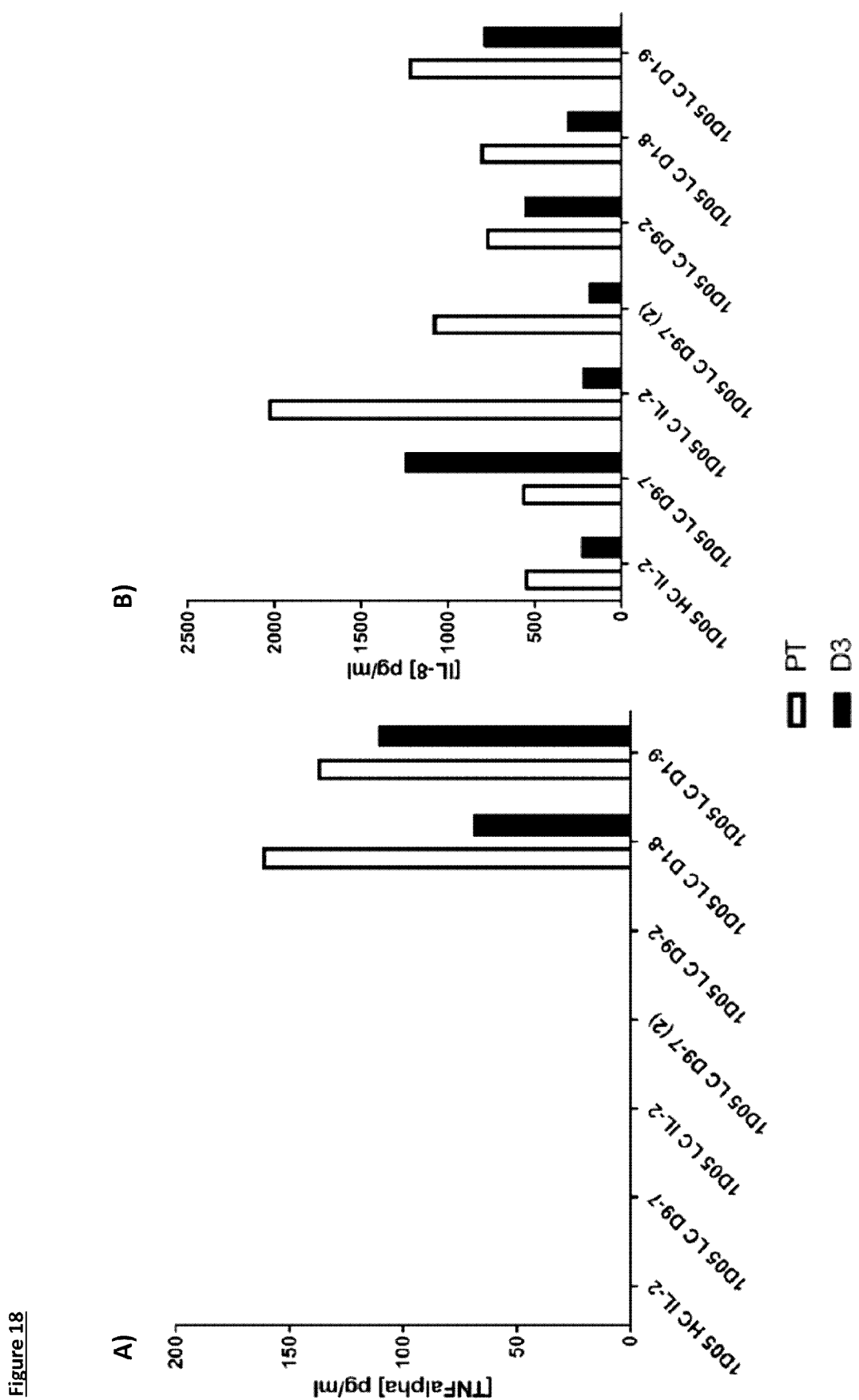
FIG. 18: Cytokine levels in plasma of cynomolgus monkeys dosed with immunocytokine molecules. Plasma samples were obtained pre-treatment (PT) and 3 days after dosing (D3) and analysed by MSD for levels of a) TNF-α; b) IL-8; c) IL-6; d) IFNγ; e) G-CSF and f) IL-2. Where no bar is included, cytokine levels were below the limit of quantification of the assay. IL4, IL-5 and IL-1β were not detectable in any sample at either timepoint and so are not included in the graphs
Figure 18:
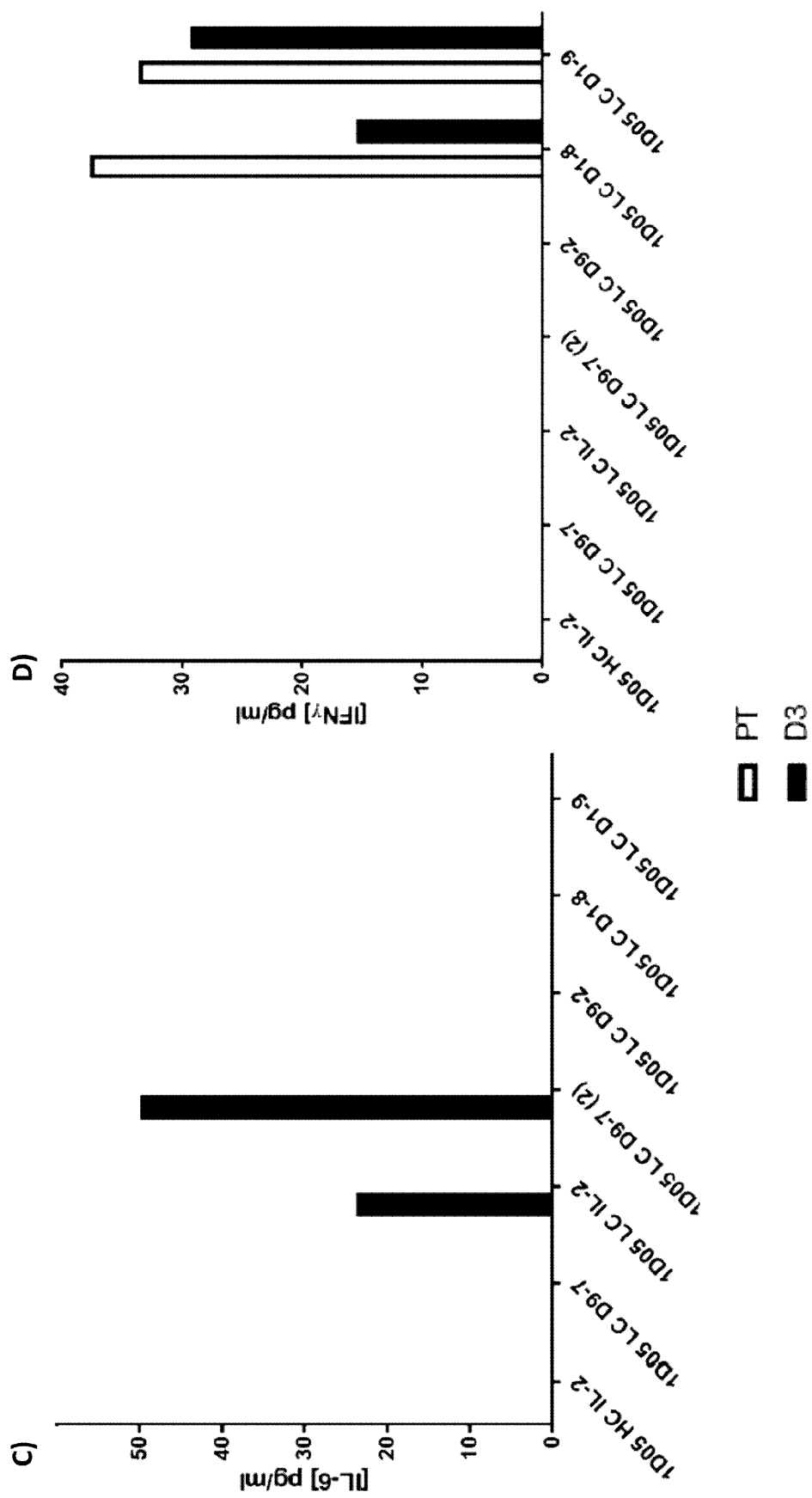
Figure 18:
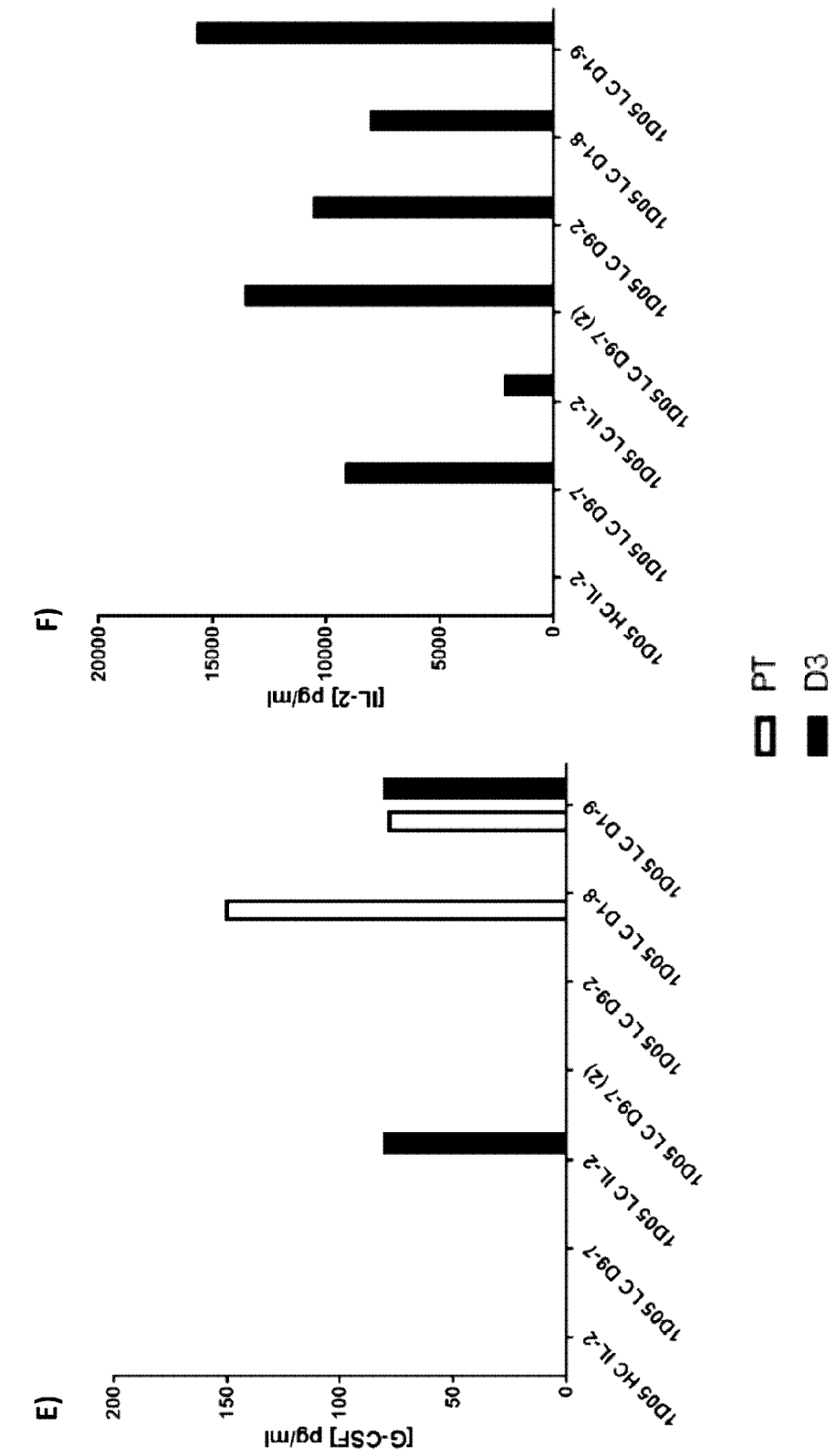
Figure 19:
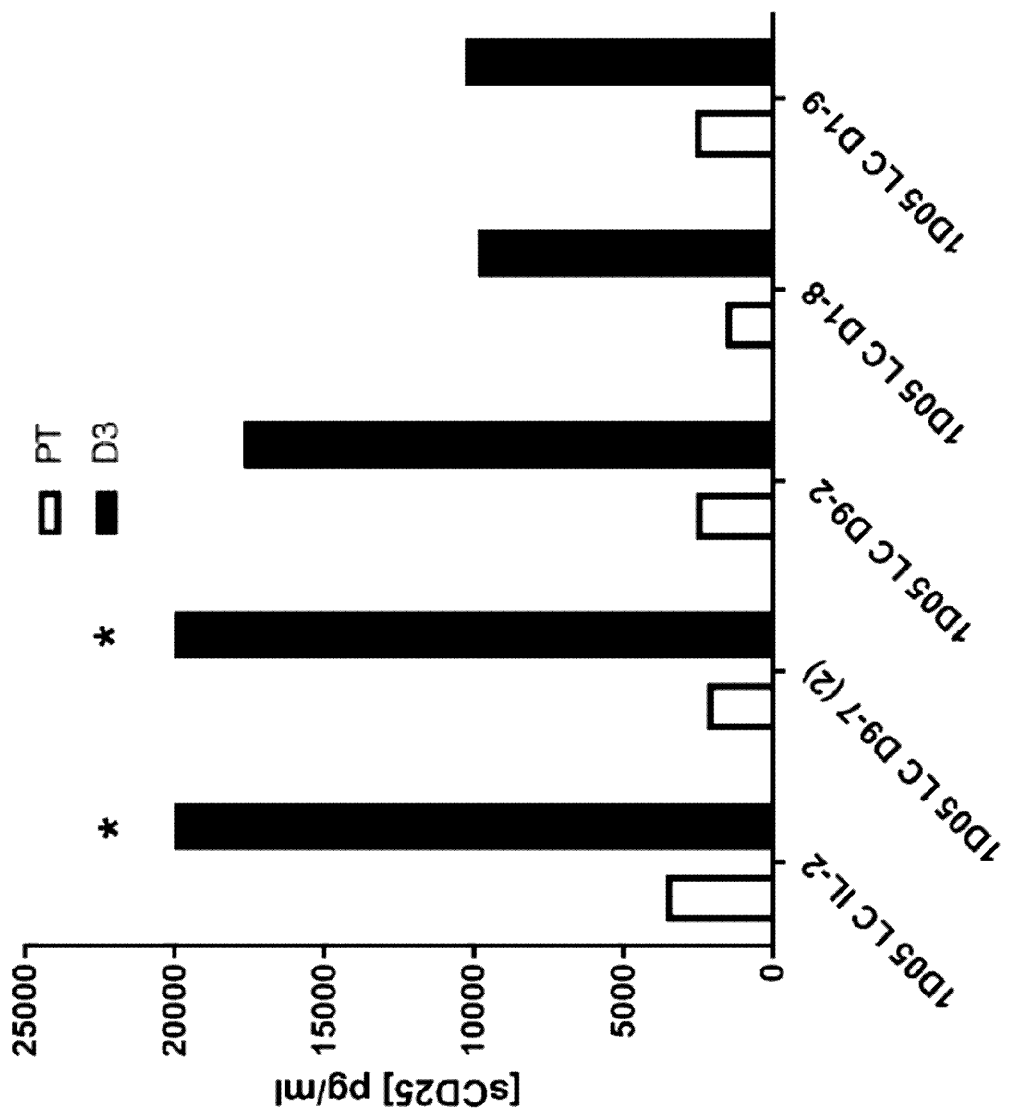
FIG. 19: Levels of soluble CD25 in plasma of cynomolgus monkeys dosed with immunocytokine molecules. Plasma samples were obtained pre-treatment (PT) and 3 days after dosing (D3) and analysed using a commercial ELISA kit. * indicates levels above limit of quantification (20,000 pg/mL)

For analysis of cytokines and soluble CD25, blood samples were taken into EDTA-treated tubes pre-treatment and 3 days post-treatment, and plasma extracted by centrifugation at 2000 g for 10 minutes. Samples were frozen until analysis by multiplex MSD (cytokines) or commercial ELISA (soluble CD25). Results are shown in FIGS. 18 and 19.

Figure 20A:
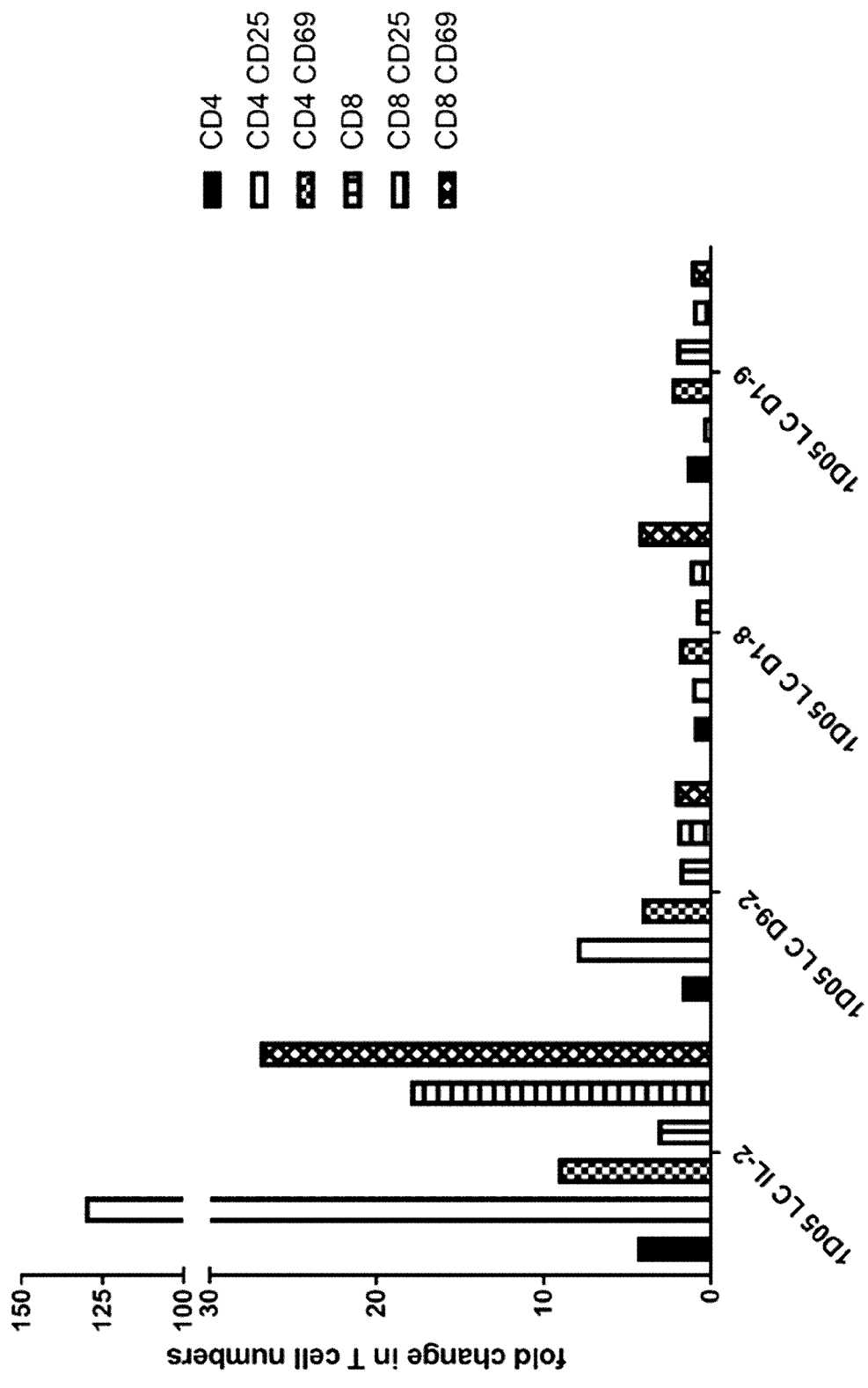
FIG. 20: Flow cytometric analysis of PBMC subsets. Whole blood was stained for markers of a) T-cells and b) B-cells, NK cells, neutrophils and monocytes, prior to red blood cell lysis and fixation. Data is expressed as the fold change in cell number 5 days after dosing. Data for 1D05 LC D9-7 ICK is missing due to unusable sample
Figure 20B:
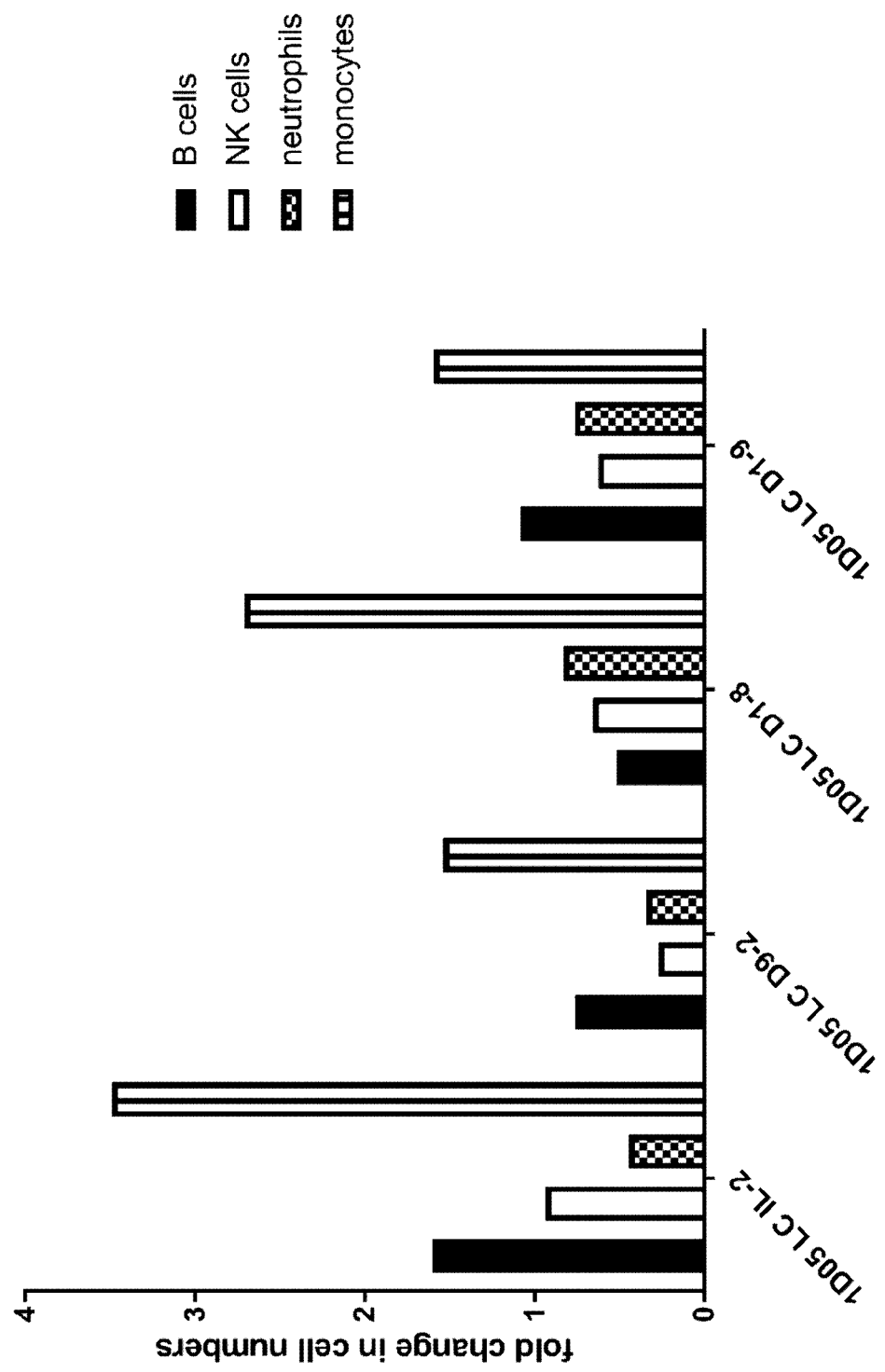

For immunophenotyping, blood samples were taken into EDTA-treated tubes pre-treatment and 5 days post-treatment. Blood samples were stained with cocktails of directly conjugated monoclonal antibodies, then red blood cells were lysed and the samples fixed by re-suspension in phosphate buffered saline containing 1% formaldehyde prior to analysis. Results are shown in FIG. 20.

For PK analysis, blood samples were taken into untreated tubes pre-treatment, end of infusion (EOI), 2, 4, 8, 16, 24, 32, 40 and 48 hours after EOI, extended to 72 hours and 96 hours for Phase 2) and serum prepared by allowing the blood to clot, then centrifugation at 2000 g for 10 min. Serum samples were frozen on dry ice for shipment to Kymab. Results are shown in FIG. 21.

Figure 21A:
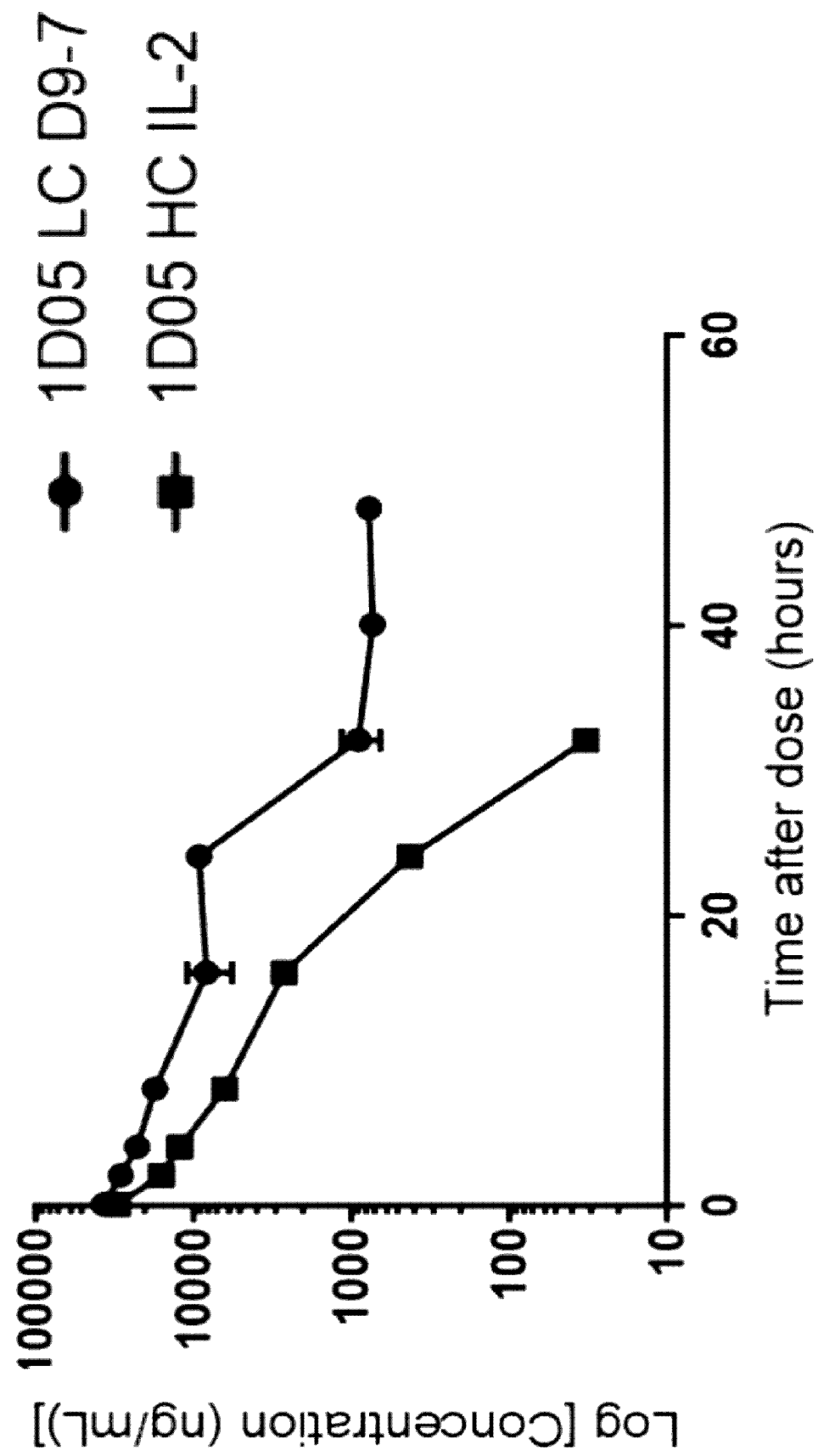
FIG. 21: Pharmacokinetic (PK) analysis of immunocytokines. Serum was prepared from blood samples taken at various time points over 96 hours. In panels a) and b), serum was incubated on plates coated with PD-L1 and immunocytokines detected with a biotinylated anti-human Fc detection antibody, and streptavidin-labelled Europium. In panels c) and d), serum was incubated on plates coated with PD-L1 and immunocytokines detected with a biotinylated anti-human IL-2 antibody, and streptavidin-labelled Europium. Results are expressed as ng/mL
Figure 21B:
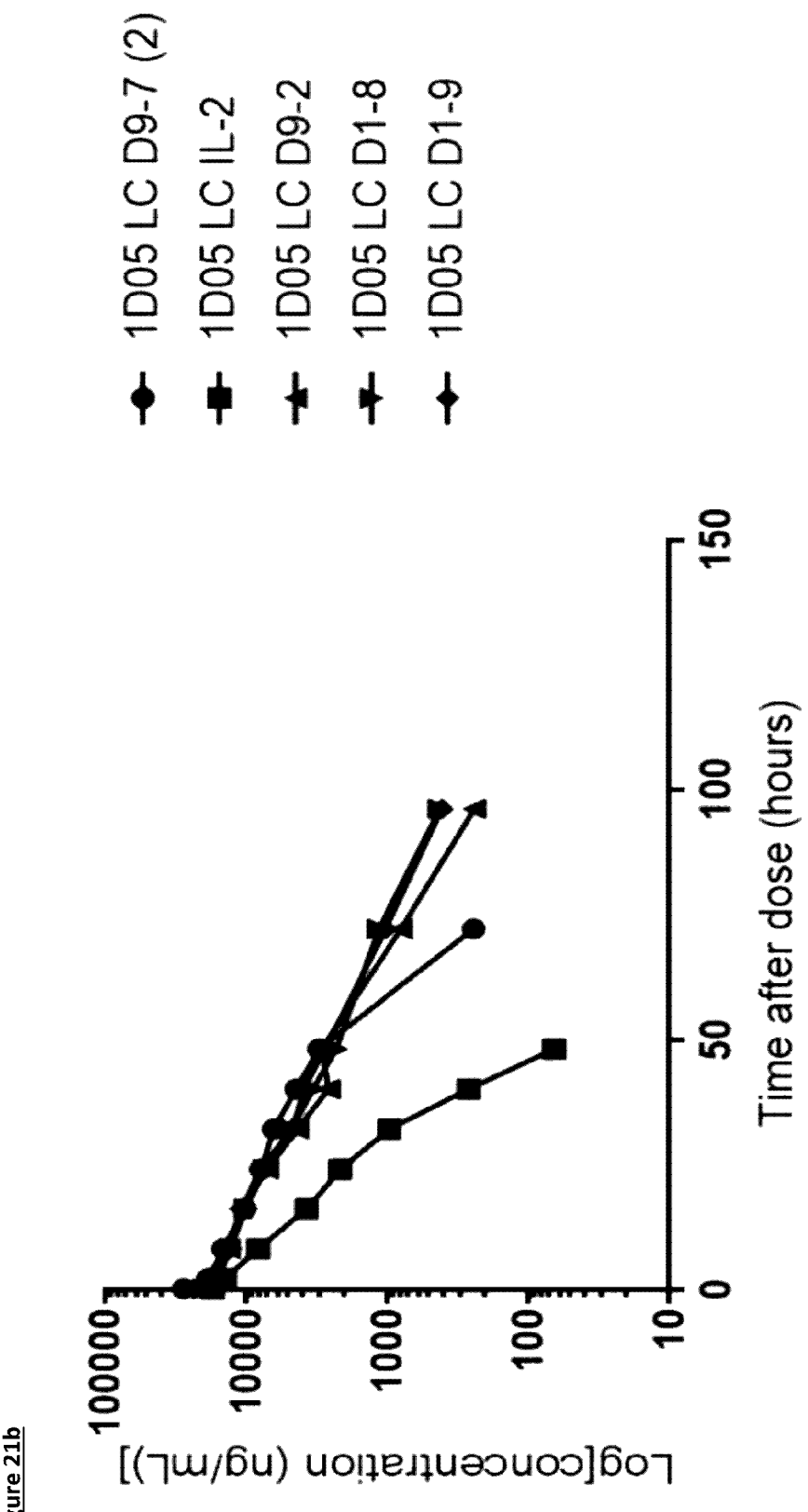

Pharmacokinetic Analysis of Serum Samples a) PK Assay for Detection of Anti-PD-L1 Antibody 50 µL/well of human PD-L1 Flag His (Seq ID No:505, in house) diluted to 2 µg/mL in PBS (Sigma, P3813-10PAK) was adsorbed to 96-well, high protein binding fluorescent plates (Greiner) overnight at 4° C. Excess protein was removed by washing 3× with 300 µL/well PBS-Tween (0.1% v/v) and the wells were blocked with 1% w/v bovine serum albumin (BSA, Sigma) in PBS for 1 hour at room temperature, after which plates were washed as described previously. Antibodies were diluted from 10,000 ng/mL to 9.77 ng/mL (1/2 dilution) in pooled cynomolgus serum (Seralab, CYNSRM) to give 12 standards including a blank. Standards, quality controls and samples were diluted at 1 in 50 MRD (minimum required dilution) in ELISA assay buffer (PBS+0.1% BSA) and were added to the coated 96-well high-binding plates at 50 µL/well. The plate was incubated for 1 hour at room temperature, after which plates were washed 3× with PBS-Tween. 50 µL biotinylated goat anti-human IgG (Southern Biotech) at 1 µg/mL was added to the plate. The plate was incubated for 1 hour at room temperature, after which plates were washed 3× with PBS-Tween. PD-L1 binding was detected using streptavidin labelled Europium (Perkin Elmer) diluted 1/1000 in DELFIA assay buffer (Perkin Elmer). Plates were washed with TBS (Tris buffered saline)-Tween (0.1% v/v) and 50 µL/well of DELFIA Enhancement solution (Perkin Elmer) was added to the plate. Time-resolved fluorescence was measured at 615 nm on an Envision plate reader (PerkinElmer). Concentrations were determined using GraphPad Prism software by interpolating from a standard curve fitted using a four-parameter logistic equation (Equation 4). Results are shown in FIGS. 21a and 21b.

b) PK Assay for Detection of Intact Immunocytokine (Antibody Fused to IL-2)

Figure 21C:
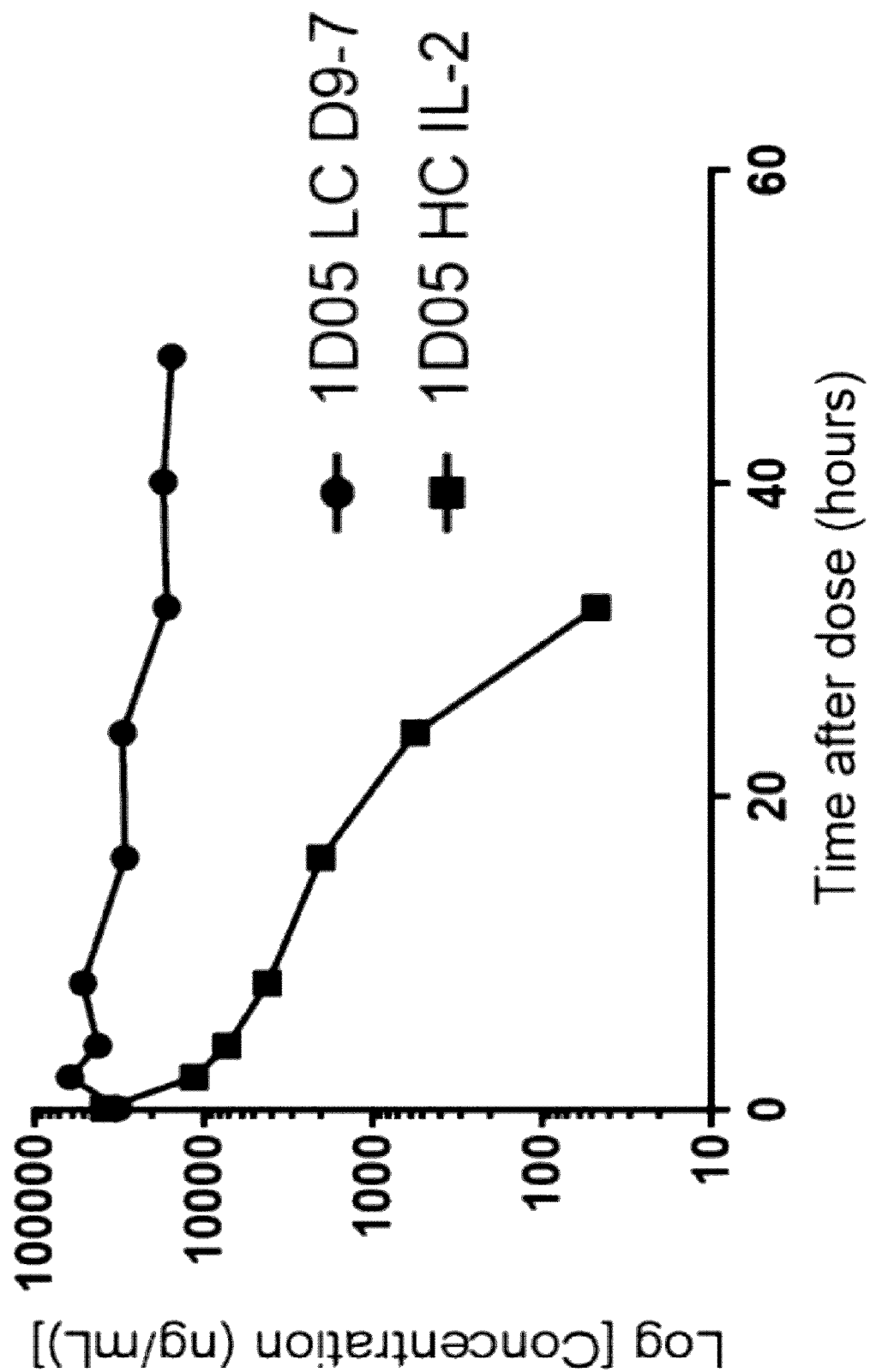
Figure 21D:
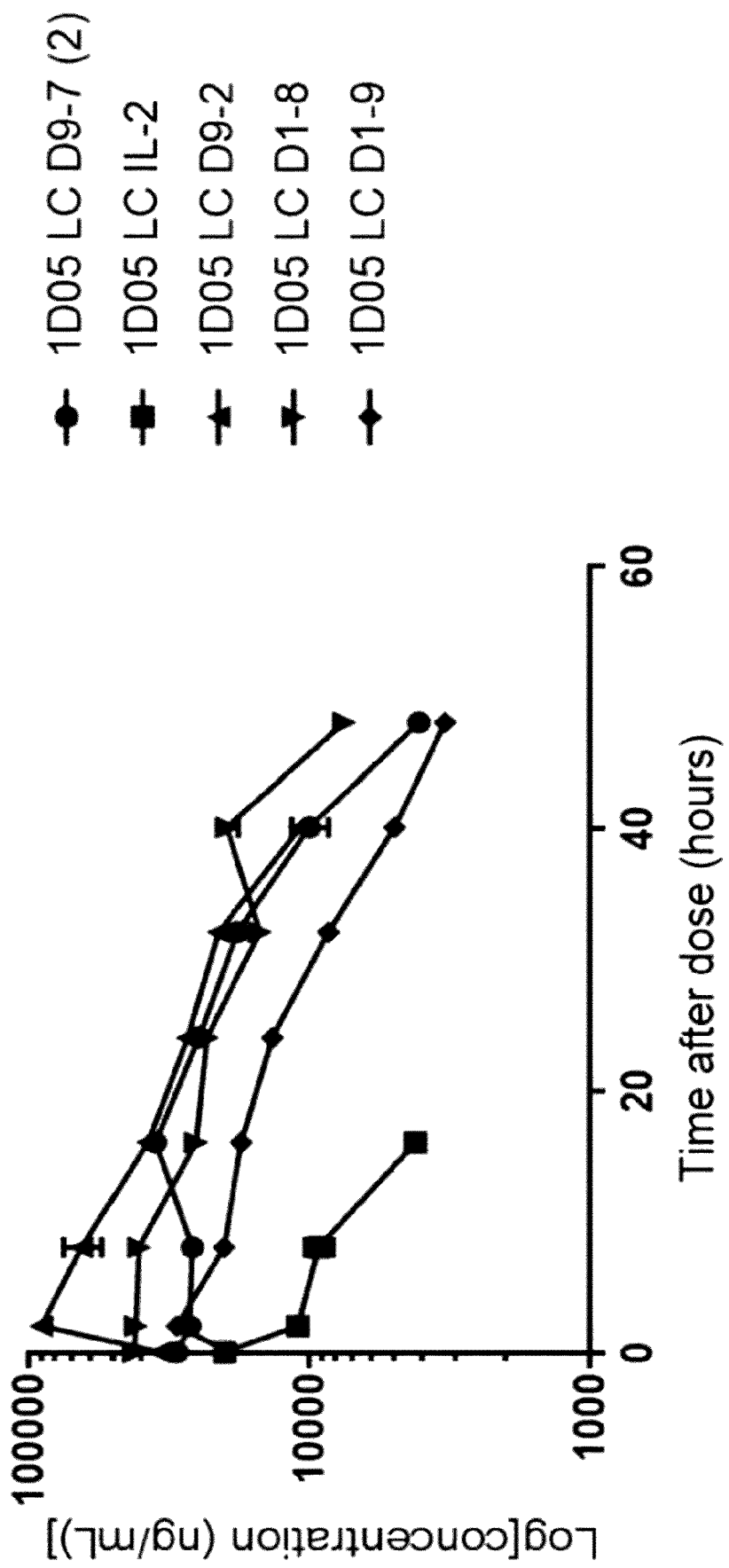

50 µL/well of human PD-L1 Flag His (Seq ID No:505 in house) diluted to 3 µg/mL in PBS (Sigma, P3813-10PAK) was adsorbed to 96-well, low auto-fluorescent, high protein binding plates (Costar) overnight at 4° C. Excess protein was removed by washing 3× with 300 µL/well PBS-Tween (0.1% v/v) and the wells were blocked with 1% w/v bovine serum albumin (BSA, Sigma) in PBS for 1 hour at room temperature, after which plates were washed 3× with PBS-Tween. Antibodies were diluted from 50,000 ng/mL to 617.3 ng/mL in pooled cynomolgus serum (Seralab, CYNSRM) to give 10 standards including a blank. Standards, quality controls and samples were diluted at 1 in 20 MRD in ELISA assay buffer (PBS+0.1% BSA) and were added to the coated 96-well high-binding plates at 50 µL/well. The plate was incubated for 1 hour at room temperature, after which plates were washed 3× with PBS-Tween. 50 µL biotinylated anti-human IL-2 (Peprotech) at 2 µg/mL was added to the plate. The plate was incubated for 1 hour at room temperature, after which plates were washed as described previously. Binding was detected using streptavidin labelled Europium (Perkin Elmer) diluted 1/1000 in DELFIA assay buffer (Perkin Elmer). Plates were washed with TBS (Tris buffered saline)-Tween (0.1% v/v) and 50 µL/well of DELFIA Enhancement solution (Perkin Elmer) was added to the plate. Time-resolved fluorescence was measured at 615 nm on an Envision plate reader (PerkinElmer). Concentrations were determined using GraphPad Prism software by interpolating from a standard curve fitted using a four-parameter logistic equation. Results are shown in FIGS. 21c and 21d.

Results Summary

No signs of overt IL-2 mediated toxicity (fever, vascular leak, diarrhoea) were observed after dosing. Lymphocyte numbers increased over the duration of the study with the different immunocytokine constructs. The constructs with the greatest truncations induced the lowest levels of lymphocyte expansion; little expansion was observed with 1D05 LC D1-9 ICK or 1D05 LC D1-8 ICK over the seven-day period, whereas 1D05 LC D9-7 ICK and the full-length IL-2 induced significant expansion. The lymphopenia observed at day 2 with some constructs is indicative of lymphocyte margination out of the circulation. This is followed by a rebound lymphocytosis which can be seen at day 5 (FIG. 16).

Administration of immunocytokine constructs did not cause significant anaemia (FIG. 17). Around a 20% reduction in haemoglobin, haematocrit and red blood cell levels was observed at day 7 with the most active constructs (1D05 HC IL-2 ICK, 1D05 LC IL2 ICK and 1D05 LC D9-7 ICK), and around a 10% reduction with the other constructs. This agrees with anecdotal evidence from studies with IL-2 heavy chain immunocytokines. Thrombocytopenia (reduced platelet count) was not observed.

IL-2 was strongly increased 3 days post-dosing, indicative of production by activated T-cells. However, there is a possibility that the assay is cross-reactive for human IL-2 and so could also detect the immunocytokine. There was no clear up- or down-regulation of any of the other cytokines post-dosing, although there was a trend for down-regulation of IL-8 levels (FIG. 18). Levels of soluble CD25, which is a biomarker of T-cell activation, were strongly increased 3 days after dosing with immunocytokines (FIG. 19). Levels of soluble CD25 correlated with the in vitro stimulatory activity of the immunocytokines described in Example 13.

Dosing with immunocytokines increases the number of activated T-cells in the blood (FIG. 20). When dosed with 1D05 LC IL-2 ICK, total $CD4^+$ and $CD8^+$ cell numbers are increased, but $CD69^+$ (early activation) and $CD25^+$ (later activation) subsets are greatly increased, compared with pre-treatment levels. The increase in cell numbers is less striking for the truncated constructs. No significant changes in B-cell, NK cell or neutrophil numbers were observed, with a moderate increase in monocyte numbers. Data for the animal dosed with 1D05 LC D9-7 ICK is not available, due to clotting of the sample.

The light chain (LC) fusions have a longer half-life than the heavy chain (HC) fusion, which agrees with previous data in mouse (Gillies S D, Protein Engineering, Design and Selection, 26:10: 561-569, 2013). The half-life of 1D05 LC IL-2 ICK was around 8 hours, and the half-life of the truncated IL-2 constructs was around two-fold longer (FIGS. 21a and 21b). The increased half-life of immunocytokines with truncated IL-2, compared with full-length IL-2, may reflect reduced binding to IL-2 receptors.

A modified assay was used to detect intact immunocytokine i.e. antibody fused to IL-2 (FIGS. 21c and 21d). This result shows that the IL-2 part of the molecule remains fused in vivo and is not cleaved.

Example 19—Extended Single Dose Study in Cynomolgus Monkeys

To determine the duration of lymphocytosis, and obtain more detailed analysis of T-cell subsets, an extended single dose study will be performed (study number HQ52PV). Female cynomolgus monkeys are dosed with 1 mg/kg immunocytokine as per Example 18 and monitored over at least 14 days. Cytokines will be analysed on days 1, 3, 7, 10 and 14, and pre-treatment. Haematology measurements will be performed on days 2, 5, 7, 10 and 14, and pre-treatment. Detection of soluble CD25 will be performed on days 3, 7 and 10, and pre-treatment. CD127 will be added to the immunophenotyping panel, to allow for detection of regulatory T-cells ($CD3^+$ $CD4^+$ $CD25^{hi}$ $CD127^{lo}$), and analysis will be performed on days 1, 5, 7, 10 and 14, and pre-treatment. PK analysis will be performed as before. Treatment groups are shown in Table 14.

TABLE 14

Treatment groups and animal numbers

| Phase | Animal | Test Item |
|---|---|---|
| 3 | 378 | 1D05 LC IL-2 ICK |
| 3 | 379 | 1D05 LC D9-7 ICK |
| 3 | 380 | 1D05 LC D9-2 ICK |

TABLE 14-continued

Treatment groups and animal numbers

| Phase | Animal | Test Item |
|---|---|---|
| 3 | 381 | 1D05 LC D1-8 ICK |
| 3 | 382 | 1D05 LC D5-9 ICK |

Figure 28:
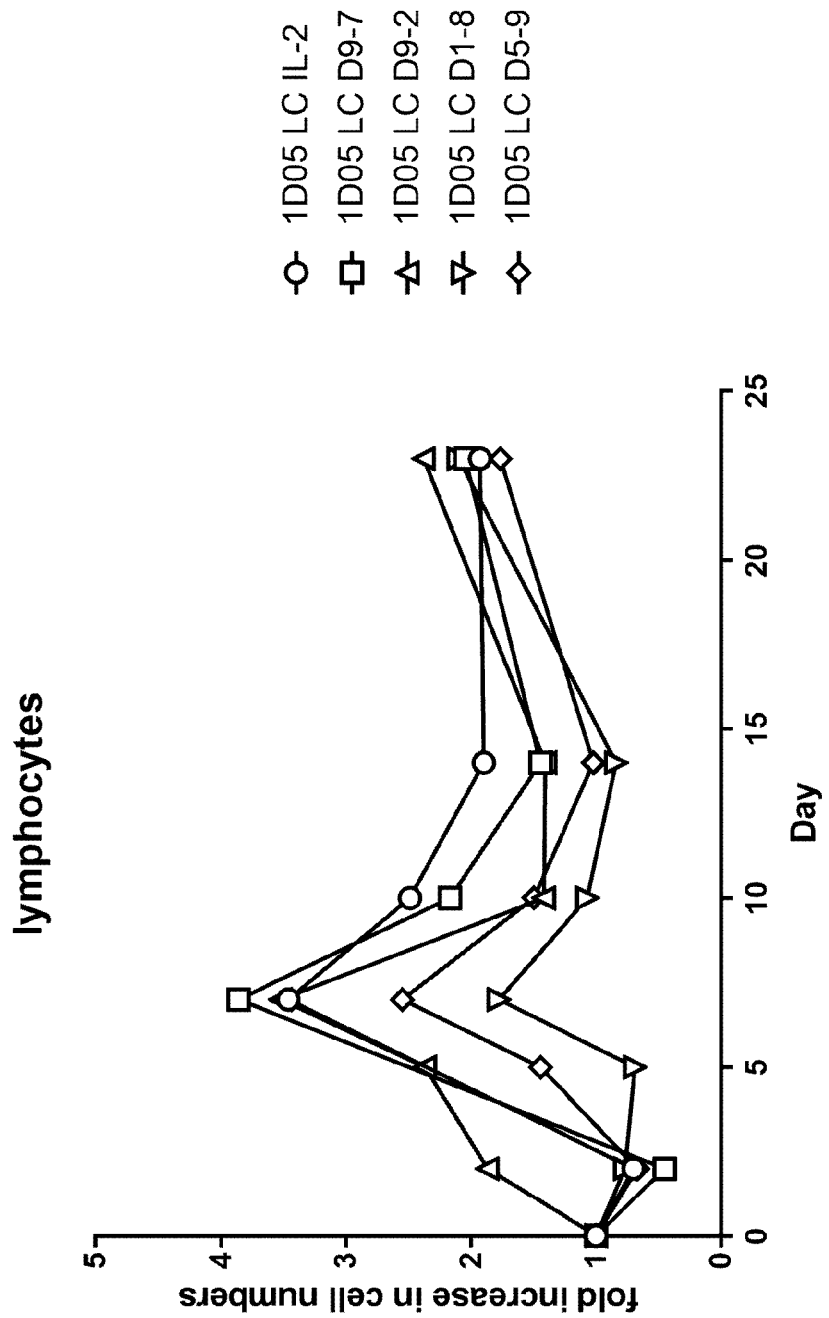
FIG. 28: Expansion of lymphocytes in response to dosing with immunocytokines. Fasting blood samples were taken into EDTA treated tubes pre-treatment (0), and 2, 5 and 7, 10, 14 and 23 days post-treatment. Cell counts were measured by the Bayer Advia 120. Results are expressed as fold change in lymphocyte count
Figure 29:
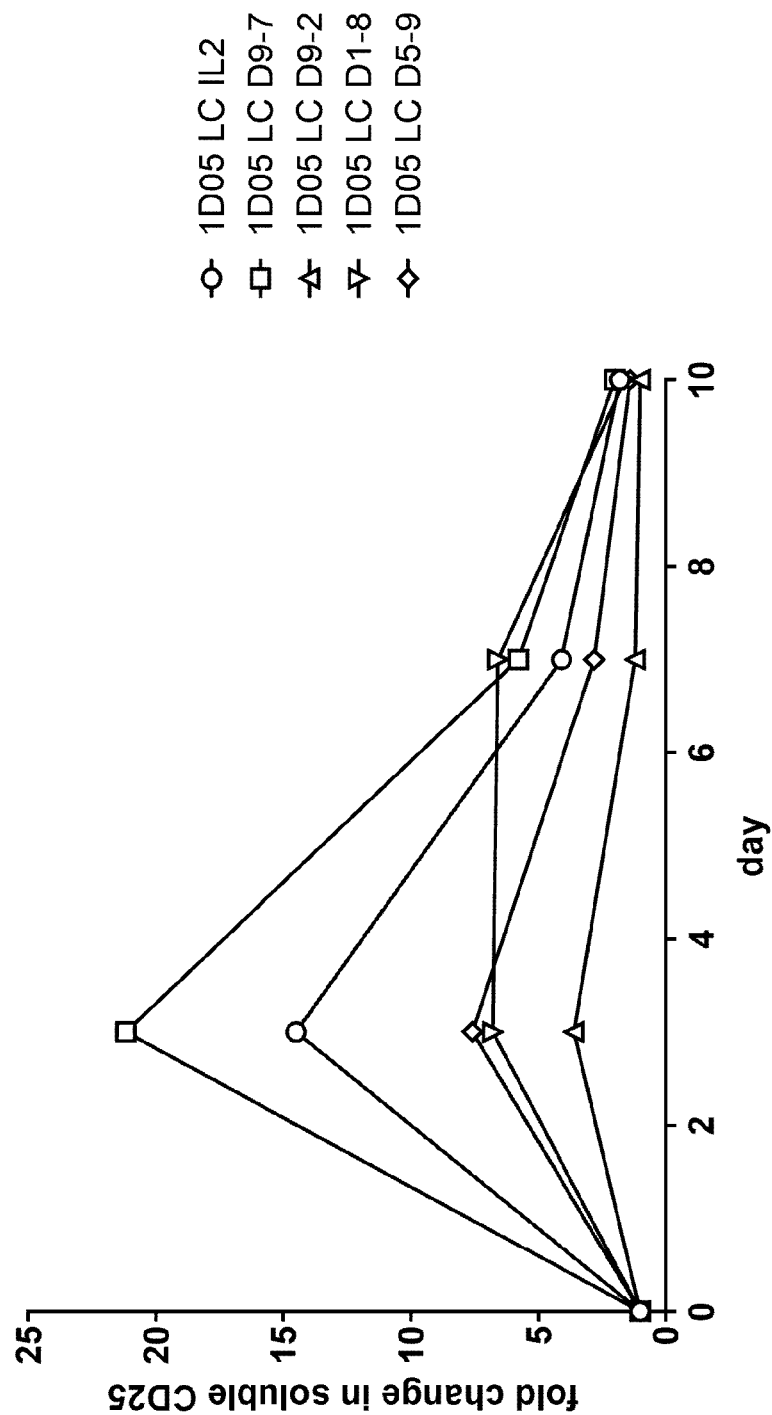
FIG. 29: Levels of soluble CD25 in plasma of cynomolgus monkeys dosed with immunocytokine molecules. Plasma samples were obtained pre-treatment (0) and 3, 7 and 10 days after dosing and analysed using a commercial ELISA kit
Figure 30A:
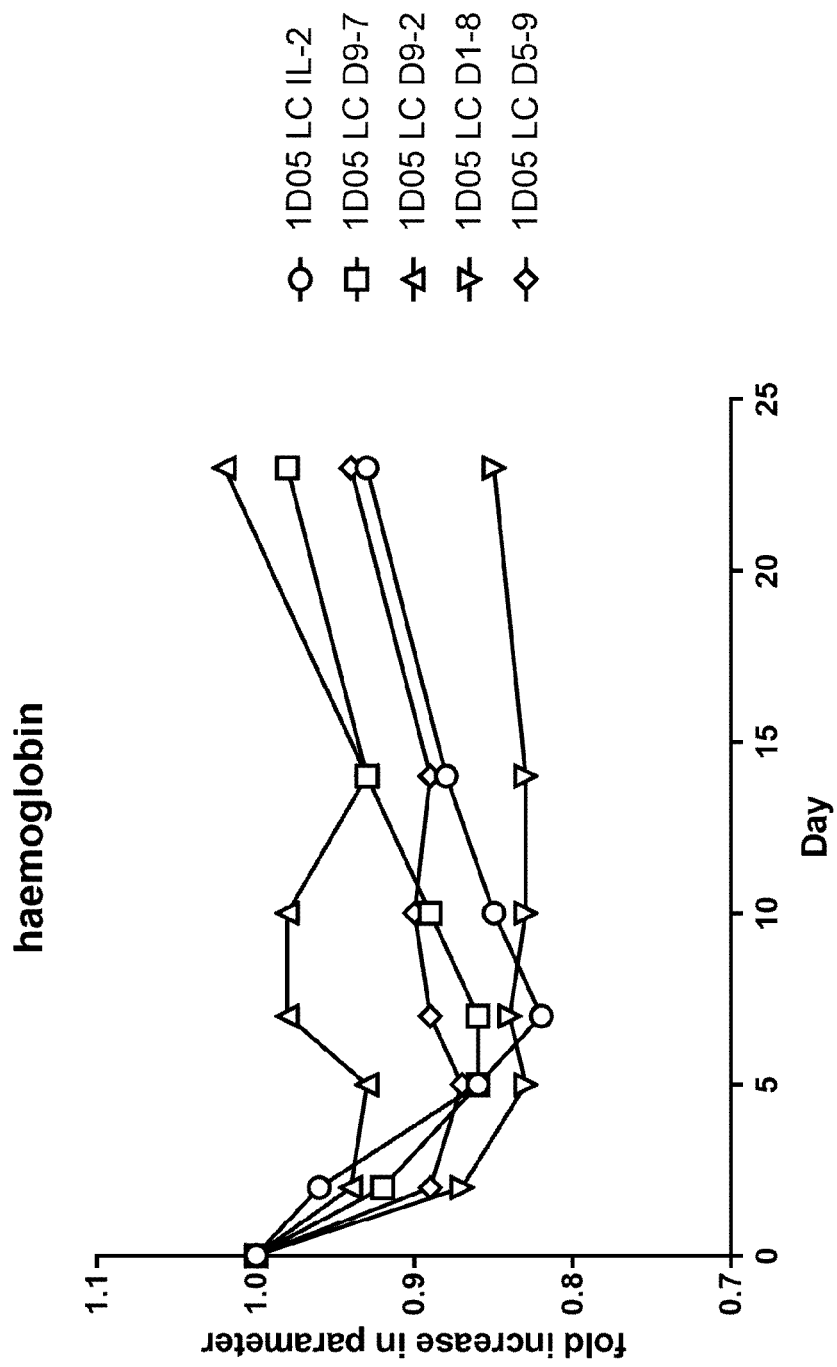
FIG. 30: Analysis of standard haematological parameters in response to dosing with immunocytokines. Fasting blood samples were taken into EDTA treated tubes pre-treatment (0) and 2, 5, 7, 10, 14 and 23 days post-treatment. Analysis of A) haemoglobin, B) haematocrit, C) red blood cell counts and D) platelet counts were performed using the Bayer Advia 120. Results are expressed as the fold change in parameter at each timepoint
Figure 30B:
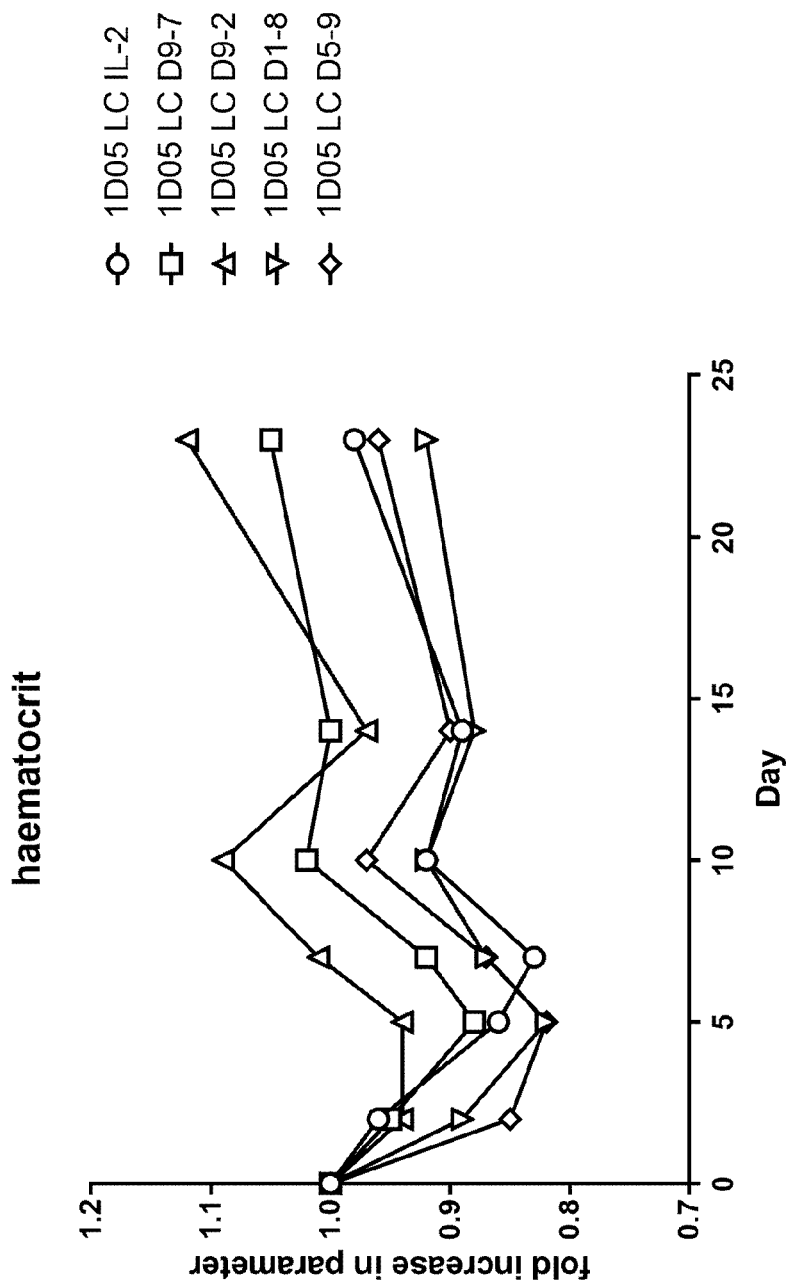
Figure 30C:
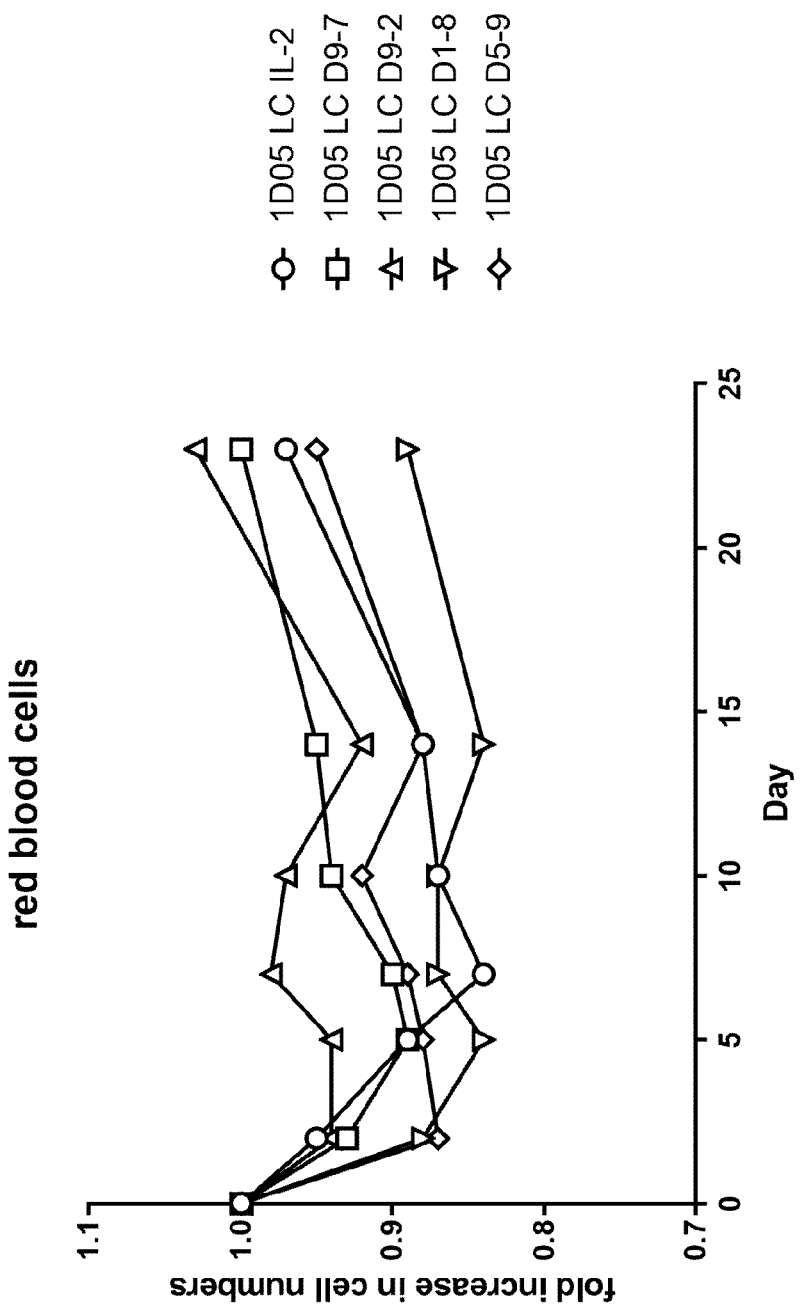
Figure 30D:
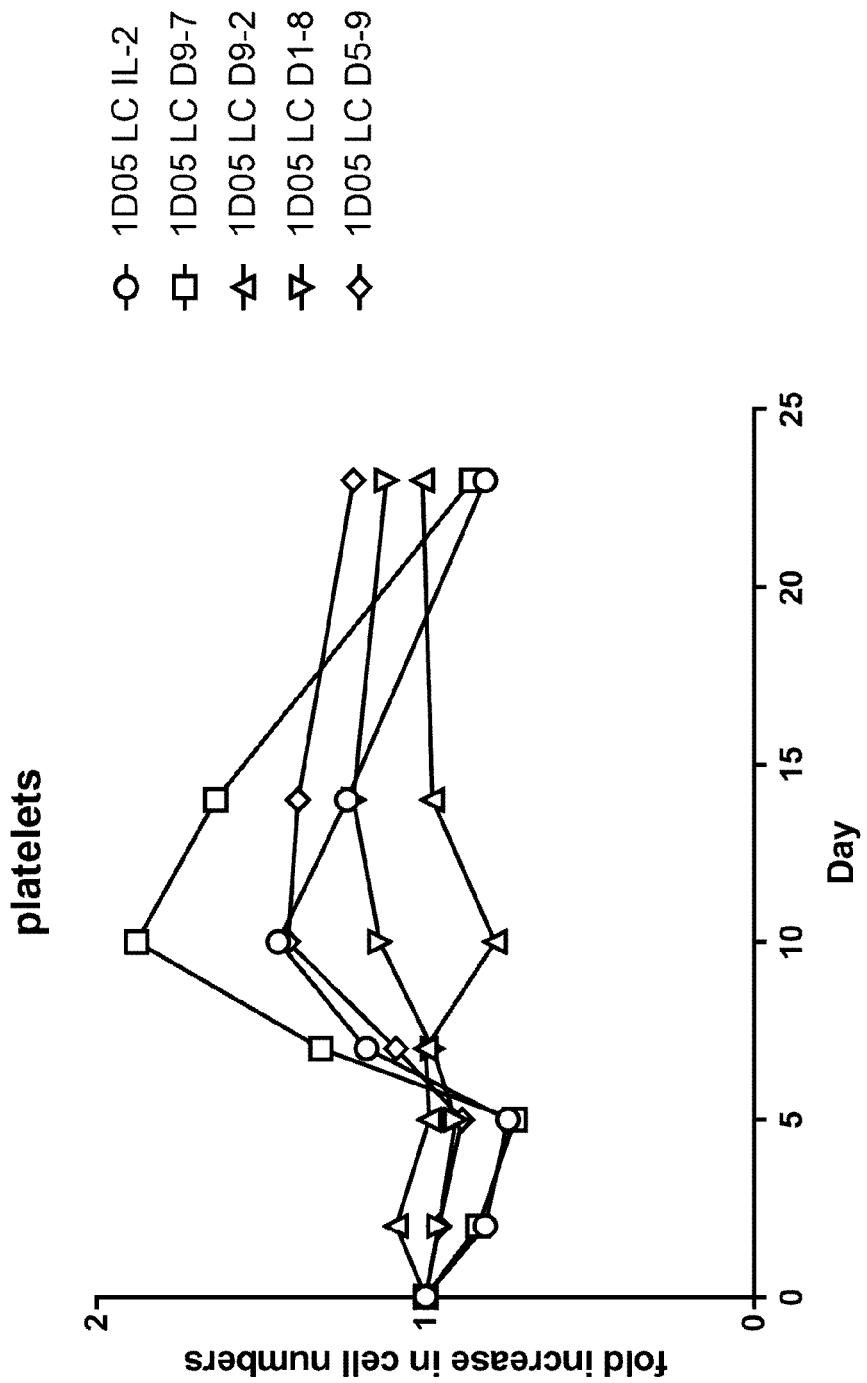

No signs of overt IL-2 mediated toxicity (fever, vascular leak, diarrhoea) were observed after dosing. Lymphocyte numbers peaked at day 7 with all immunocytokine constructs. The constructs with the greatest truncations induced the lowest levels of lymphocyte expansion; the least expansion was observed with 1D05 LC D1-8 ICK, whereas 1D05 LC D9-7 ICK and the full-length IL-2 induced the greatest expansion. The lymphopenia observed at day 2 with some constructs is indicative of lymphocyte margination out of the circulation. This is followed by a rebound lymphocytosis (FIG. 28). Levels of soluble CD25, which is a biomarker of T-cell activation, peaked 3 days after dosing with immunocytokines (FIG. 29). Levels of soluble CD25 correlated with the in vitro stimulatory activity of the immunocytokines described in Example 13.

Figure 31A:
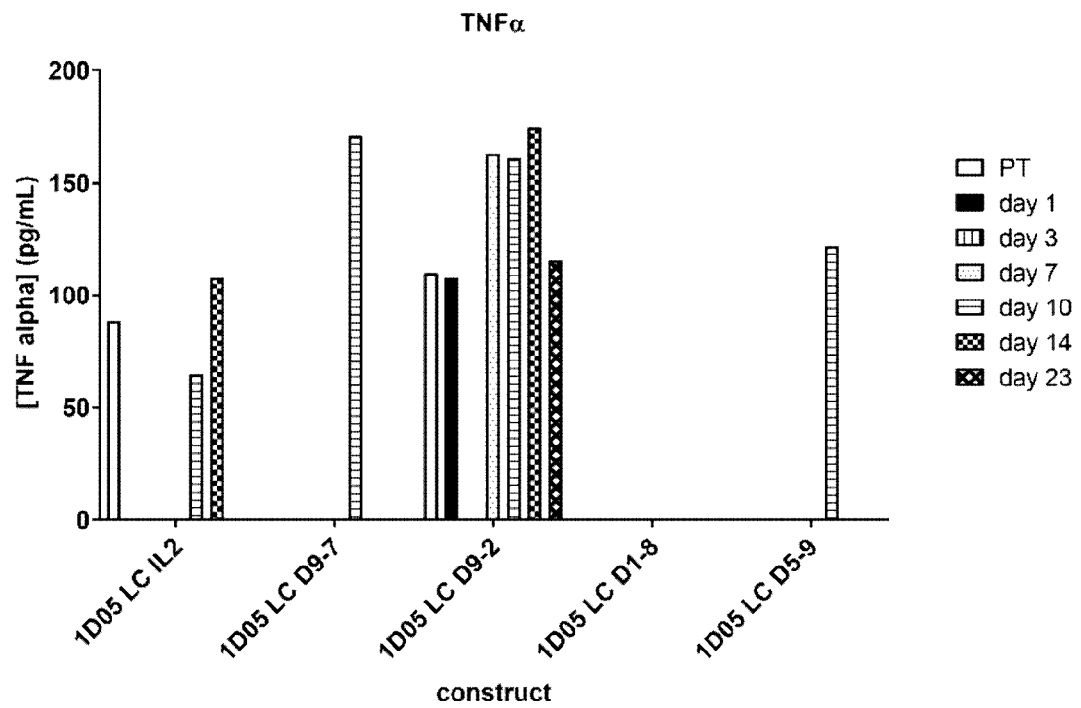
FIG. 31: Cytokine levels in plasma of cynomolgus monkeys dosed with immunocytokine molecules. Plasma samples were obtained pre-treatment (0) and 1, 3, 7, 10, 14 and 23 days after dosing and analysed by MSD for levels of a) TNF-α; b) IL-8; c) IL-6; d) IFNγ; e) G-CSF, f) IL-2, g) IL-4 and h) IL-5. Where no bar is included, cytokine levels were below the limit of quantification of the assay. IL-1β was not detectable in any samples and so is not included in the graphs
Figure 31B:
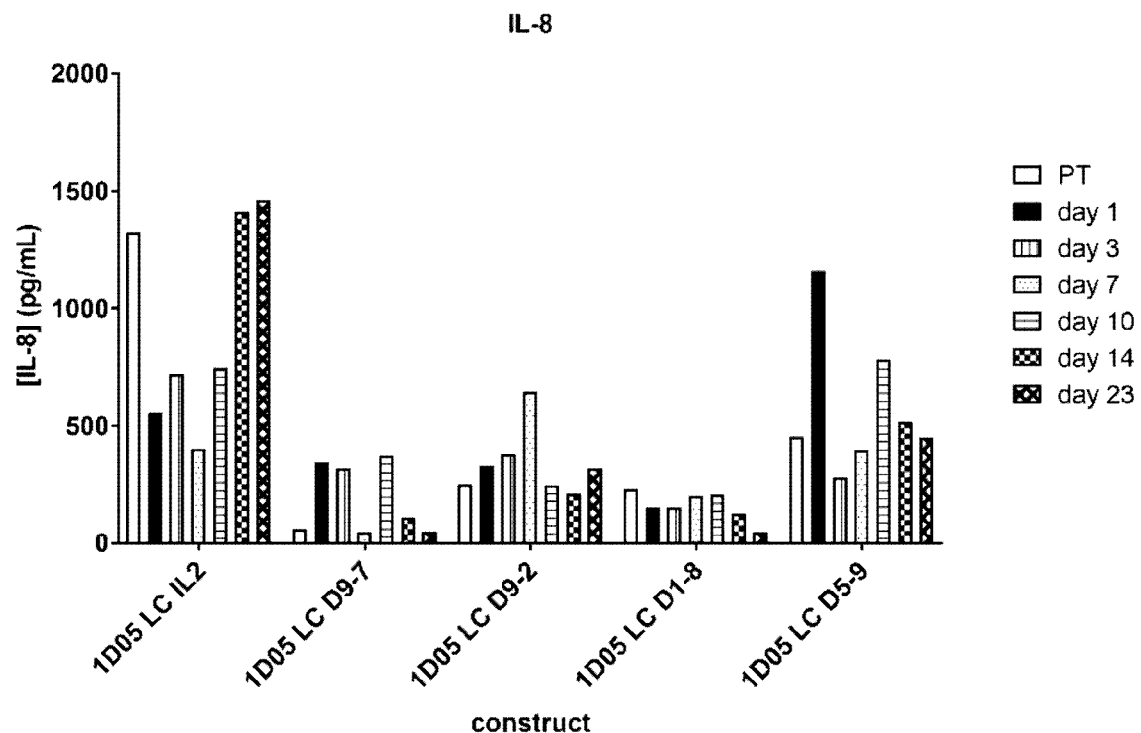
Figure 31C:
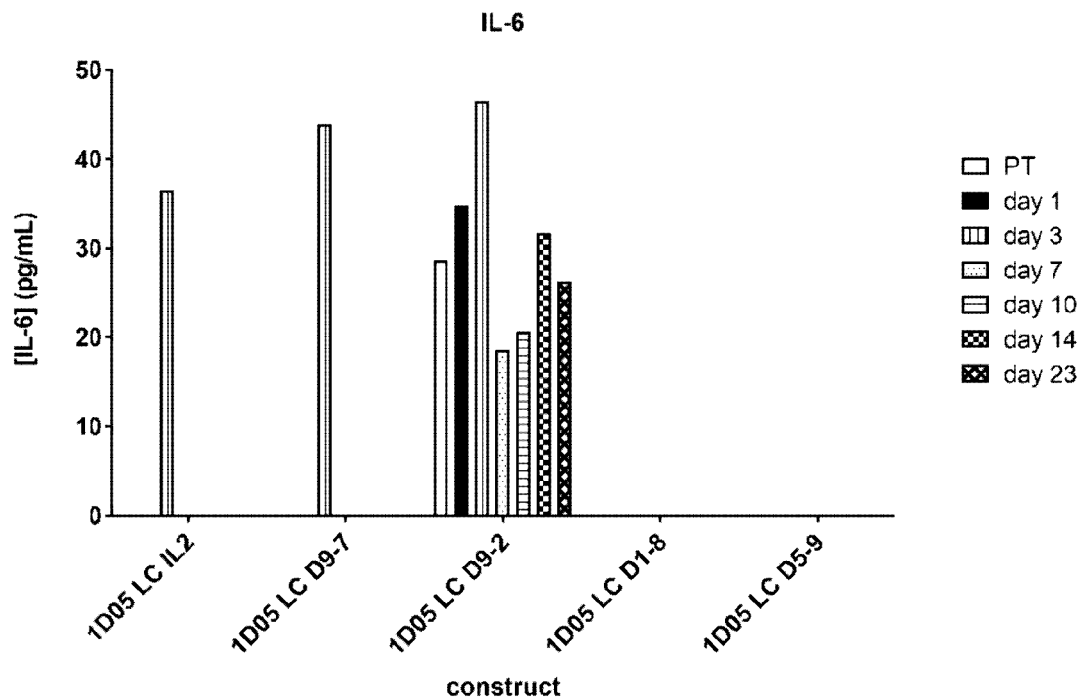
Figure 31D:
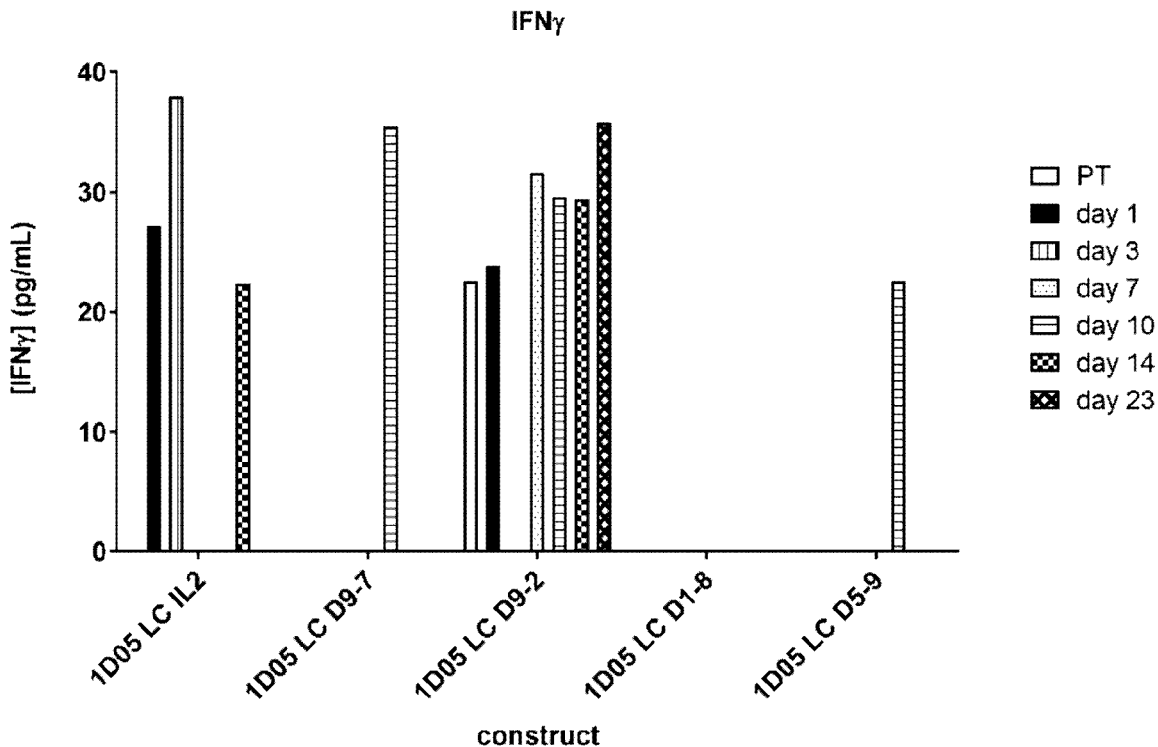
Figure 31:
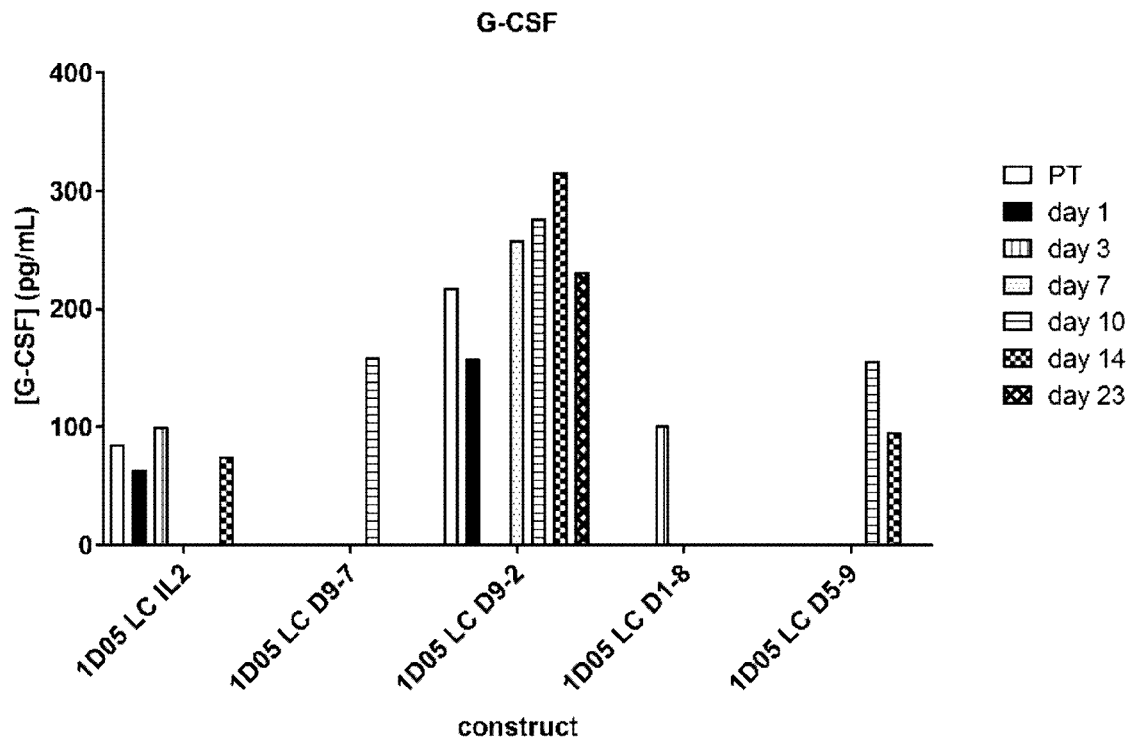
Figure 31F:
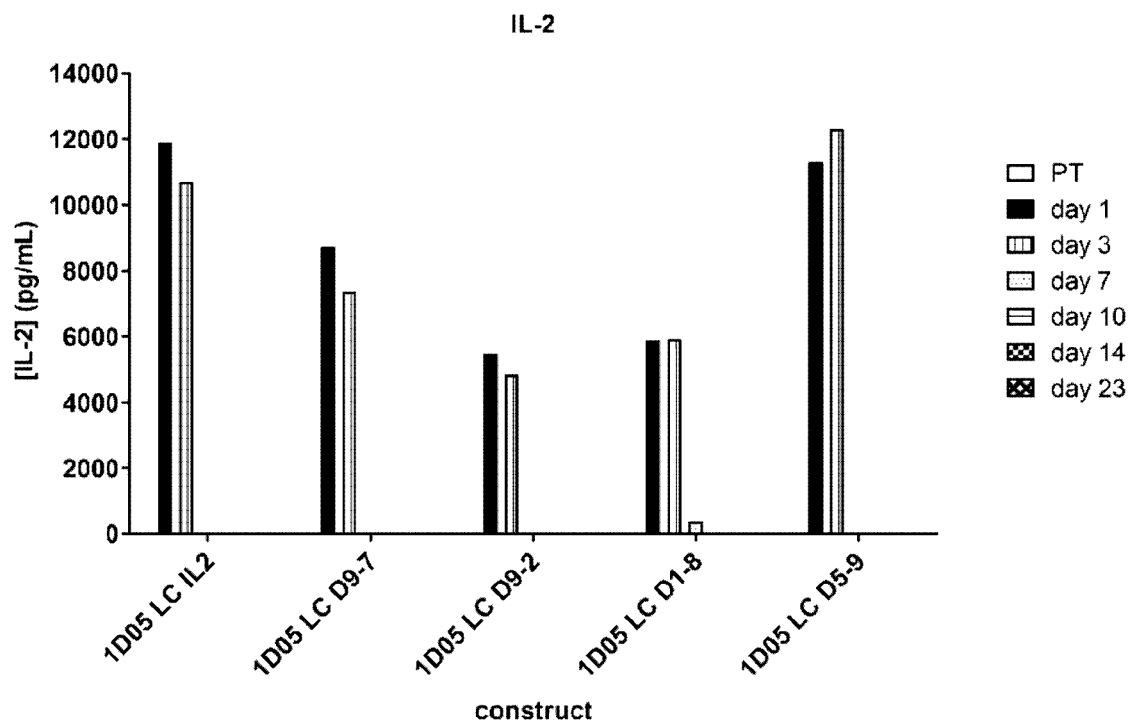
Figure 31G:
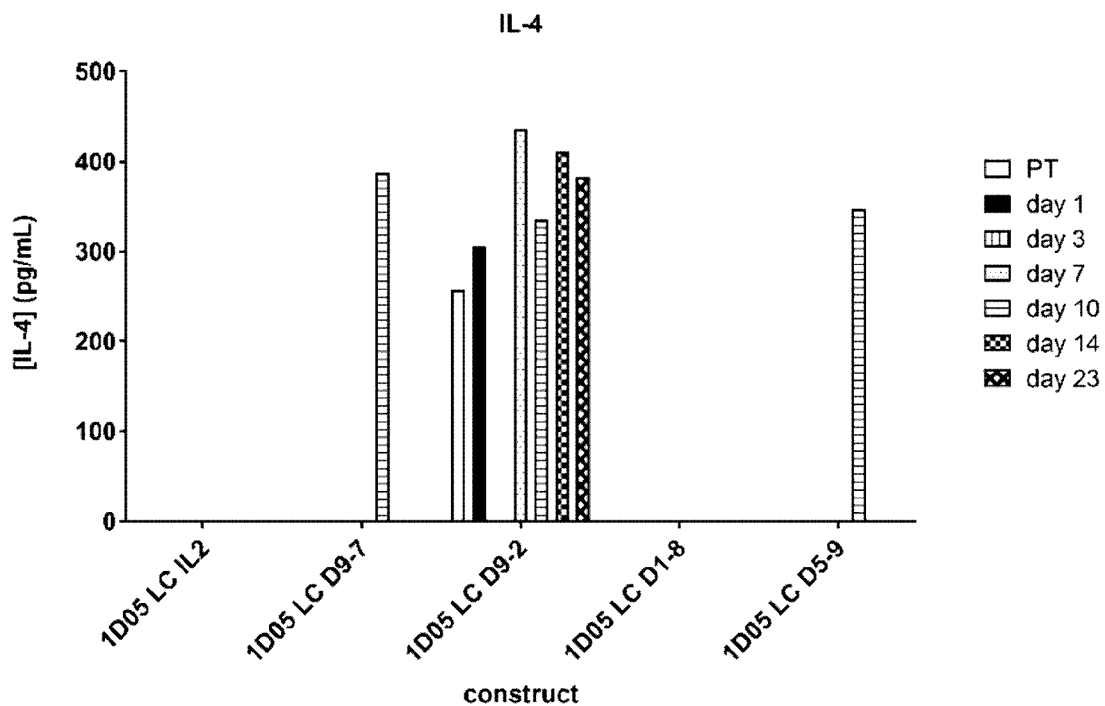
Figure 31H:
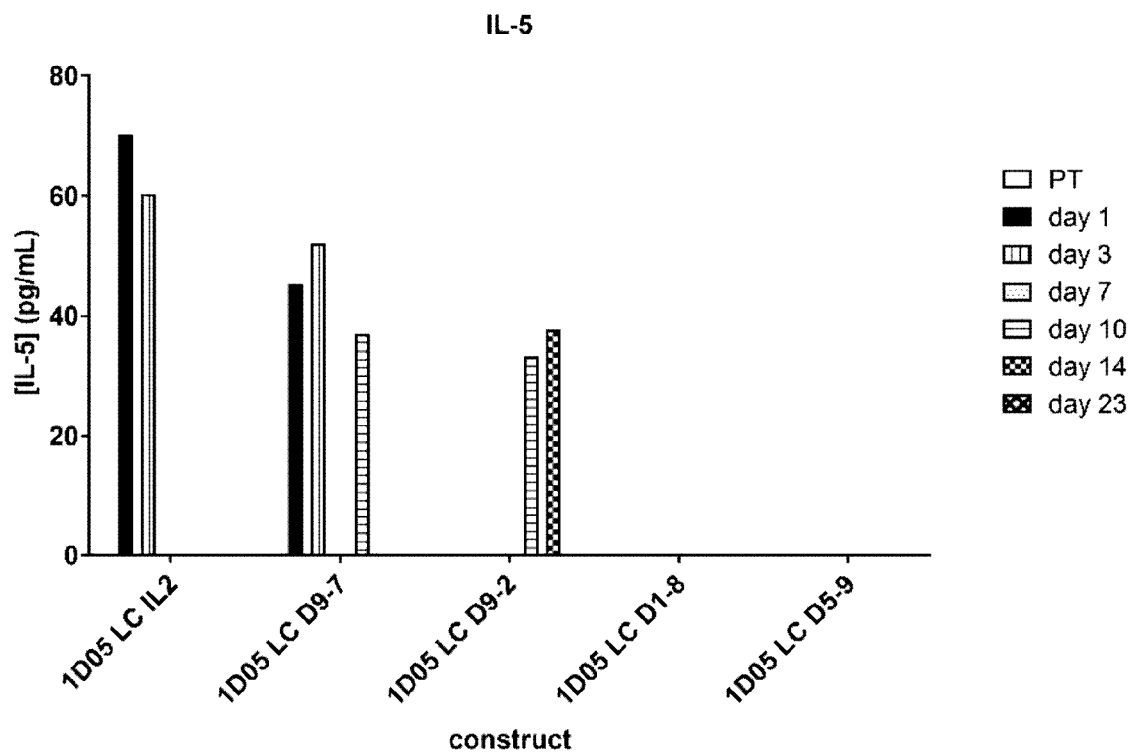

Administration of immunocytokine constructs did not cause significant anaemia (FIG. 30). A 10-20% reduction in haemoglobin, haematocrit and red blood cell levels was observed with the immunocytokine constructs. Haemoglobin levels remained lower over the entire time course in the animal dosed with 1D05 LC D1-8 ICK. Mild thrombocytopenia was observed with the two most active constructs at day 5, but levels recovered after this timepoint. IL-2 was strongly increased 3 days post-dosing, indicative of production by activated T-cells. However, there is a possibility that the assay is cross-reactive for human IL-2 and so these levels reflect the presence of the immunocytokine. There was no clear up- or down-regulation of any of the other cytokines post-dosing (FIG. 31).

Figure 32:
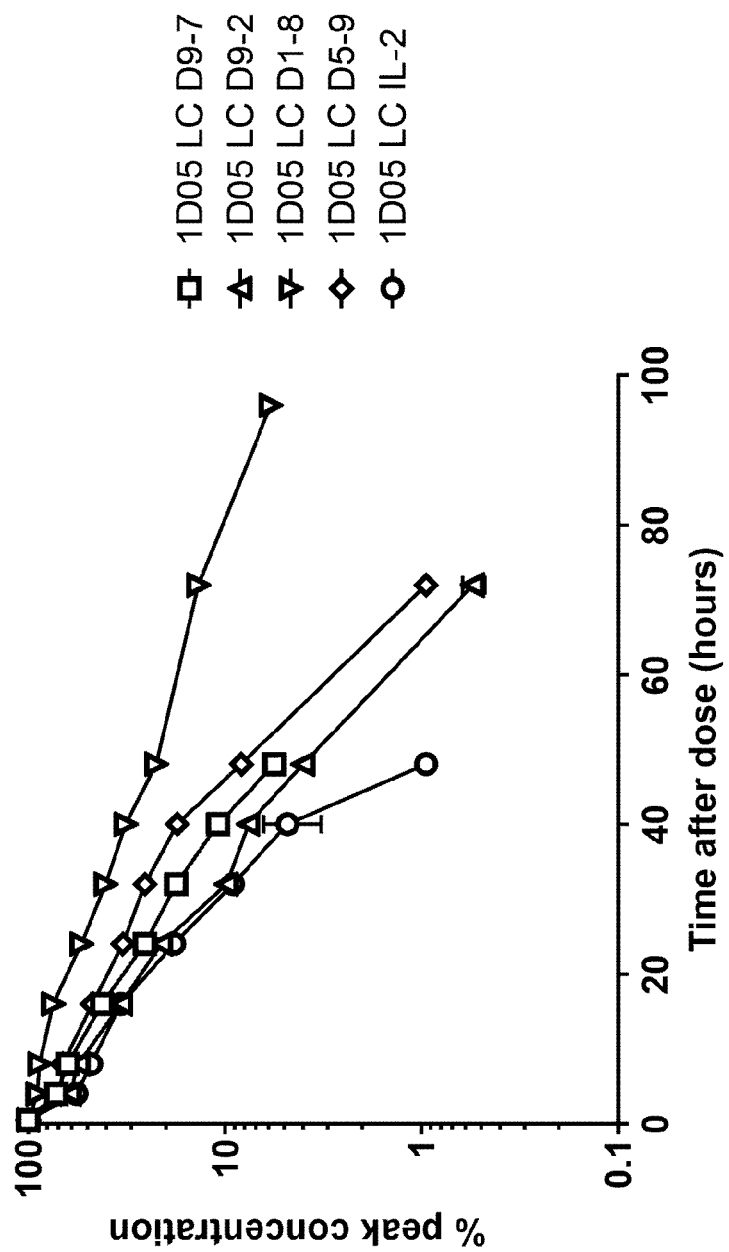
FIG. 32: Pharmacokinetic (PK) analysis of immunocytokines. Serum was prepared from blood samples taken at various time points over 96 hours. Serum was incubated on plates coated with PD-L1 and immunocytokines detected with a biotinylated anti-human Fc detection antibody, and streptavidin-labelled Europium. Results are expressed as % peak concentration

As observed previously in Example 18, the half-life of 1D05 LC IL-2 ICK was around 8 hours, and the half-life of the truncated IL-2 constructs correlated with the size of the truncation (FIG. 32). The immunocytokine construct containing the longest truncation, D1-8, had the longest half-life, of approximately 24 hours. The increased half-life of immunocytokines with truncated IL-2, compared with full-length IL-2, may reflect reduced binding to IL-2 receptors.

Figure 33A:
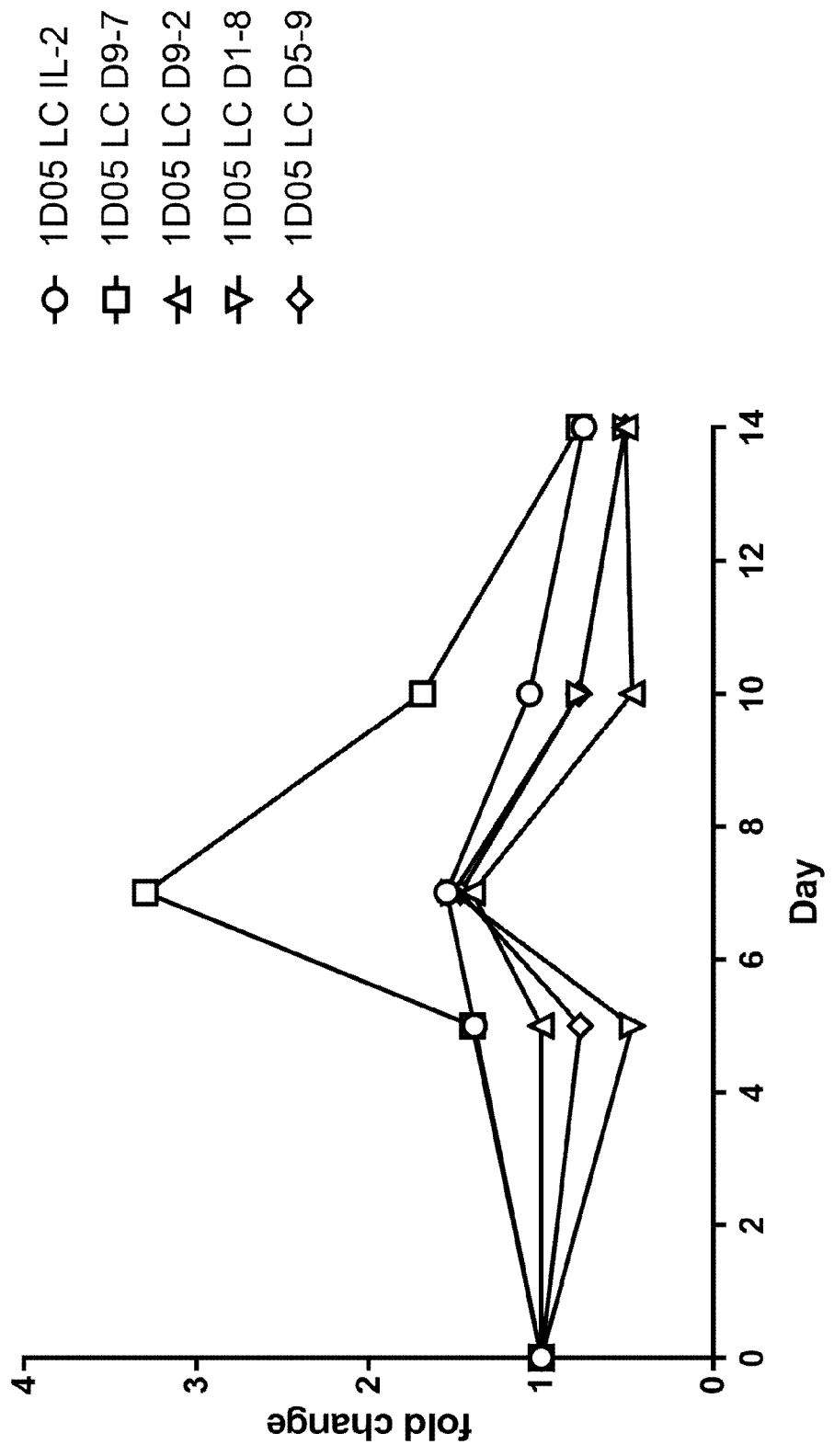
FIG. 33: Expansion of specific T-cell subsets by ICK molecules. Whole blood was incubated with antibodies for staining, before red blood cell lysis, fixation and analysis by flow cytometry. Results are expressed as fold change in absolute (a) CD4$^+$ T-cell and (b) CD8$^+$ T-cell numbers at each timepoint.
Figure 33B:
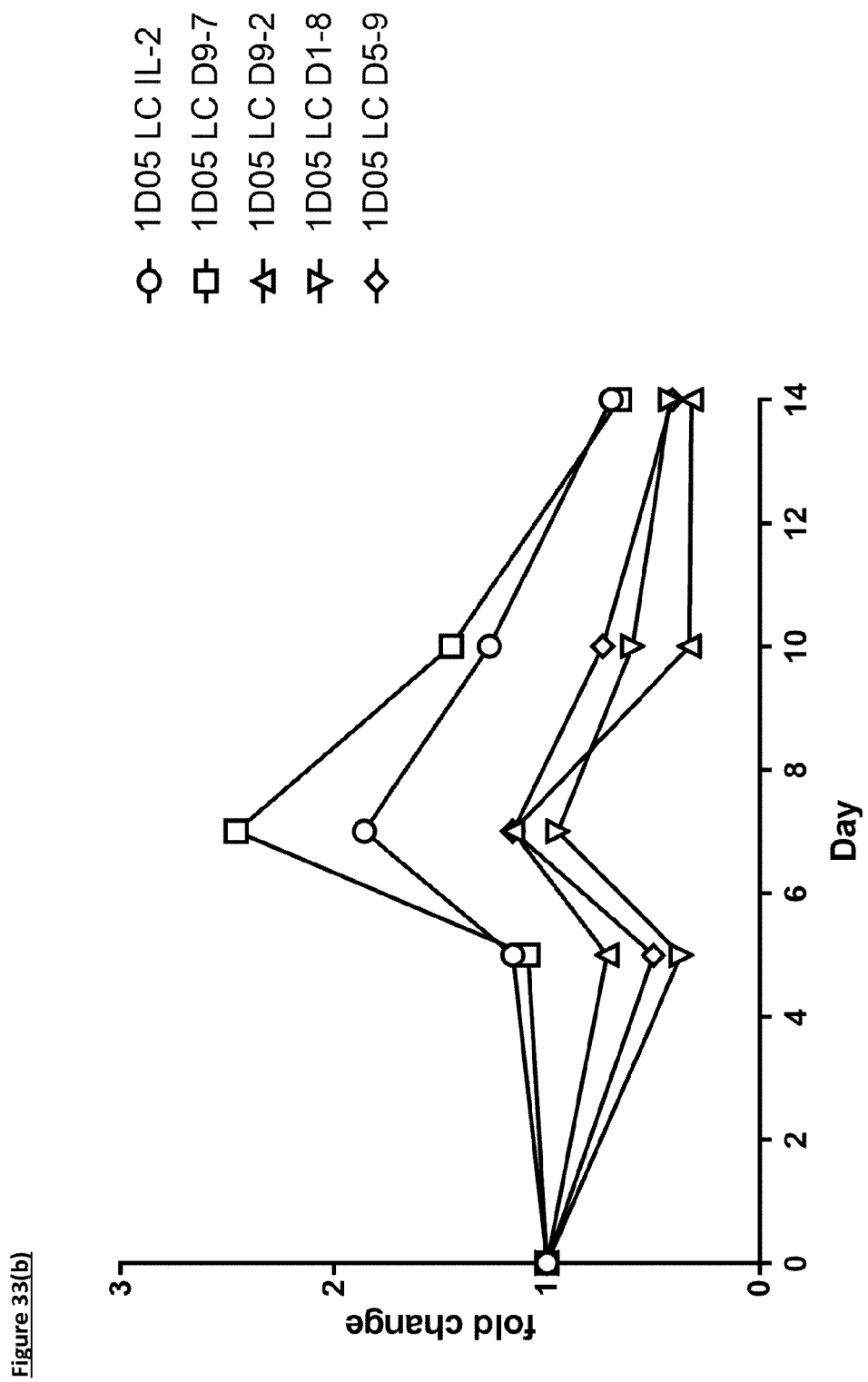

Expansion of CD4$^+$ and CD8$^+$ T-cells is shown in FIG. 33. As observed for the automated cell counts, the degree of expansion correlates well with the size of the IL-2 truncation, the greatest expansion of both T-cell subsets observed in the animal dosed with 1D05 LC ICK D9-7.

Example 20—Binding to Cell Endogenously Expressed hPD-L1 and Neutralisation of hPD-L1 Binding to PD-1 and CD80

Lead antibodies are tested for ability to bind to ES2 cells endogenously expressing hPD-L1 as well as the neutralisation of PD-L1/PD-1 interaction and PD-L1/CD80 interactions. ES2 cells endogenously expressing hPD-L1 (ATCC) are diluted in FACS buffer (PBS 1% BSA 0.1% sodium azide) and distributed to three 96-well, V-bottom plate (Greiner) at a density of 0.5-1×10$^5$ cells per well. Cells are washed with 150 µL PBS and centrifuged at 300 g for 3 minutes. Supernatant is aspirated and 150 µL PBS added. This wash step is repeated.

To plate 1 (PD-L1 binding), 25 µL lead antibody, reference antibody or control antibody diluted in FACS buffer is added to the washed cells. 25 µL FACS buffer is added and cells are incubated at 4° C. for 60 minutes. 150 µL FACS buffer is added and cells washed as described above. To detect anti-PD-L1 antibody binding, anti-human PE (Jackson ImmunoResearch) is diluted 1/500 in FACS buffer and 50 µL of this mixture added to cells. Cells are incubated 4° C. for 60 minutes. Cells are washed twice with 150 µL FACS buffer, centrifuging at 300 g for 3 minutes after each wash step and aspirating supernatant. Cells are fixed by addition of 50 µL 4% paraformaldehyde and overnight incubation at 4° C. Cells are washed once as above and resuspended in FACS buffer for analysis. PE signal intensity (geometric mean) is measured by flow cytometry using a Beckman Coulter Cytoflex instrument. Data is plotted as geometric mean values without further calculation.

To plate 2 (PD-1 neutralisation) 25 µL lead antibody, reference antibody or control antibody diluted in FACS buffer is added to the washed cells. 25 µL of biotinylated human PD-1 (in-house, Fc-tagged, SEQ ID No:6) is added and cells are incubated at 4° C. for 60 minutes. Biotinylation is performed in-house using Lightning Link conjugation kit (Innova Biosciences) according to manufacturer's instructions. 150 µL FACS buffer is added and cells washed as described above. To detect biotinylated PD-1, Streptavidin-Alexa Fluor 647 (AF647, Jackson ImmunoResearch) is diluted 1/500 in FACS buffer and 50 µL of this mixture added to cells. Cells are incubated at 4° C. for 60 minutes. Cells are washed twice with 150 µL FACS buffer, centrifuging at 300 g for 3 minutes after each wash step and aspirating supernatant. Cells are fixed, washed and resuspended for analysis as above. APC signal intensity (geometric mean) is measured by flow cytometry. Data is plotted as geometric mean values without further calculation.

To plate 3 (CD80 neutralisation) 25 µL lead antibody, reference antibody or control antibody diluted in FACS buffer is added to the washed cells. 25 µL biotinylated human CD80 (Fc tagged, R&D Systems, 140-B1) is added and cells are incubated at 4° C. for 60 minutes. All other steps are performed as per plate 2.

Alternatively, to simultaneously detect binding and neutralisation, ES2 cells expressing hPD-L1 are diluted in FACS buffer and are distributed to two 96-well, V-bottom plate (Greiner) at a density of 0.5-1×10$^5$ cells per well. Cells are washed with 150 µL PBS and centrifuged at 300 g for 3 minutes. Supernatant is aspirated and 150 µL PBS added. This wash step is repeated.

25 µL lead antibody, reference antibody or control antibody diluted in FACS buffer is added to the washed cells. 25 µL biotinylated human PD-1 (R&D Systems, 8986-PD-100, his-tagged) or CD80 (R&D Systems, 9050-B1-100, his-tagged) is added and cells are incubated at 4° C. for 60 minutes. 150 µL FACS buffer is added and cells washed as described above. To detect biotinylated PD-1 or CD80 and anti-PD-L1 antibody binding, streptavidin-AF647 and anti-human PE are each diluted 1:500 in FACS buffer and 50 µL of this mixture added to cells. Cells are incubated at 4° C. for 60 minutes. Cells are washed twice with 150 µL FACS buffer, centrifuging at 300 g for 3 minutes after each wash step and aspirating supernatant. Cells are fixed, washed and resuspended for analysis as above. PE and APC signal intensity (geometric mean) are measured by flow cytometry. Data is plotted as geometric mean values without further calculation. Alternatively, an anti-his tag antibody conjugated to APC (R&D Systems) may be used to detect PD-1 or CD80, or PD-1 and CD80 may be directly labelled with AF647.

Example 21—Testing of Lead Anti-PD-L1 Antibodies in Reporter Cell Bioassay

The ability of anti-PDL1 antibodies to neutralise PD-L1/PD-1 interaction on cells will be determined using a bioluminescence cell based assay (Promega®). PD-L1 aAPC/CHO-K1 cells, transfected with PD-L1 and a cell surface protein designed to promote TCR activation, are co-cultured with PD-1 expressing Jurkat cells. These cells also present a NFAT induced luciferase responsive element. Co-culture of the two cell types in the presence of an antibody able to block PD-1-PD-L1 interaction activates TCR signaling and NFAT-mediated luciferase activity.

The assay is run according to manufacturer's recommendations. Briefly, PD-L1 aAPC/CHO-K1 cells are cultured overnight in Hams F12 medium supplemented with 10% hiFBS. The next day, media is removed, effector PD-1 Jurkat cells and anti-PD-L1 antibodies are added to assay plates for 6 hours at 37° C. in RPMI 1640 supplemented with 1% hiFBS. Plates are read following 10 minutes of incubation with Bio-Glo™ on the Envision plate reader using luminescence settings. Antibody-induced luciferase activity is represented as fold induction compared to assay signal of wells showing background levels of response as defined by Equation 8. $EC_{50}$ values are calculated using a 4-parameter logistic fit (Equation 4).

Fold induction=sample well/basal luciferase response    Equation 8

Basal luciferase response=value from wells containing PD-L1 CHO-K1 cells and PD-1 Jurkat cells

Example 22—Pharmacokinetic Study of Lead Antibodies in hPD-L1 Expressing Mice Lead antibodies, in human IgG1 effector enabled format (i.e. having a constant region of wild type IgG1, Seq ID No:341), are dosed intra-peritoneally at 10 mg/kg in mice expressing human PD-L1, eight mice per antibody. Blood samples are taken pre-treatment and at 2, 4, 8, 12, 24, 48, 72, 96, 192, 336, 508 and 672 hours. Serum is prepared and samples frozen until analysis. Samples will be analysed according to the method described for detection of antibody in Example 18 with the following exception: serum from C57BL/6 mice will be used as the vehicle in which to prepare standard curves and blanks. Minimum required dilution will differ from Example 18 due to the larger dose administered; this will be determined empirically.

Example 23—Pharmacokinetic Study of Lead Antibodies in Non-Human Primates

Lead antibodies, in human IgG1 effector enabled format (i.e. having a constant region of wild type IgG1, Seq ID No:341), are dosed intravenously at 10 mg/kg in male cynomolgus monkeys, three animals per antibody. Blood samples are taken pre-treatment and at 2, 4, 8, 12, 24, 48, 72, 96, 192, 336, 508 and 672 hours. Serum is prepared and samples frozen until analysis. Samples will be analysed according to the method described for detection of antibody in Example 18. Minimum required dilution will differ from Example 18 due to the larger dose administered; this will be determined empirically.

Example 24: Lead Antibody Activity in a Mouse B Cell:T-Cell Hybridoma Assay

Antibodies were tested in a murine B cell:T-cell hybridoma co-culture assay to assess induction of IL-2. 50 µL of human PD-L1 (SEQ ID No:1) transfected LK35.2 mouse B-lymphocyte hybridoma cells (ATCC) prepared in DMEM (Gibco) supplemented with 1% Foetal Bovine Serum (Gibco) were treated with 10 µM $Ovalbumin_{323-329}$ peptide (Thermo Scientific) and dispensed at a density of $2 \times 10^4$ cells/well in a 96-well tissue culture treated plate (Costar). Ovalbumin peptide loaded cells were then mixed with 50 µL 1:3 titration series of anti-PD-L1 antibodies or anti-ICOS/PD-L1 bi-specific antibodies in a $mAb^2$™ format from 30 nM for 9 concentration points in DMEM supplemented with 1% Foetal Bovine Serum.

Following 1 hour incubation at 37° C. 5% $CO_2$, 100 µL of murine T-helper hybridoma cell line DO-11-10 (National Jewish Health) cultured overnight in DMEM (Gibco) supplemented with 1% Foetal Bovine Serum (Gibco) were added to assay plate at $2 \times 10^4$ cells/well. LK35.2/DO-11-10 co-culture was incubated overnight at 37° C. 5% CO2 before supernatant was collected to assess production of mouse IL-2. Cells treated with 1 or 0.1× working stock of cell stimulation cocktail (eBioscience) were used as positive control for murine IL-2 production.

Figure 23A:
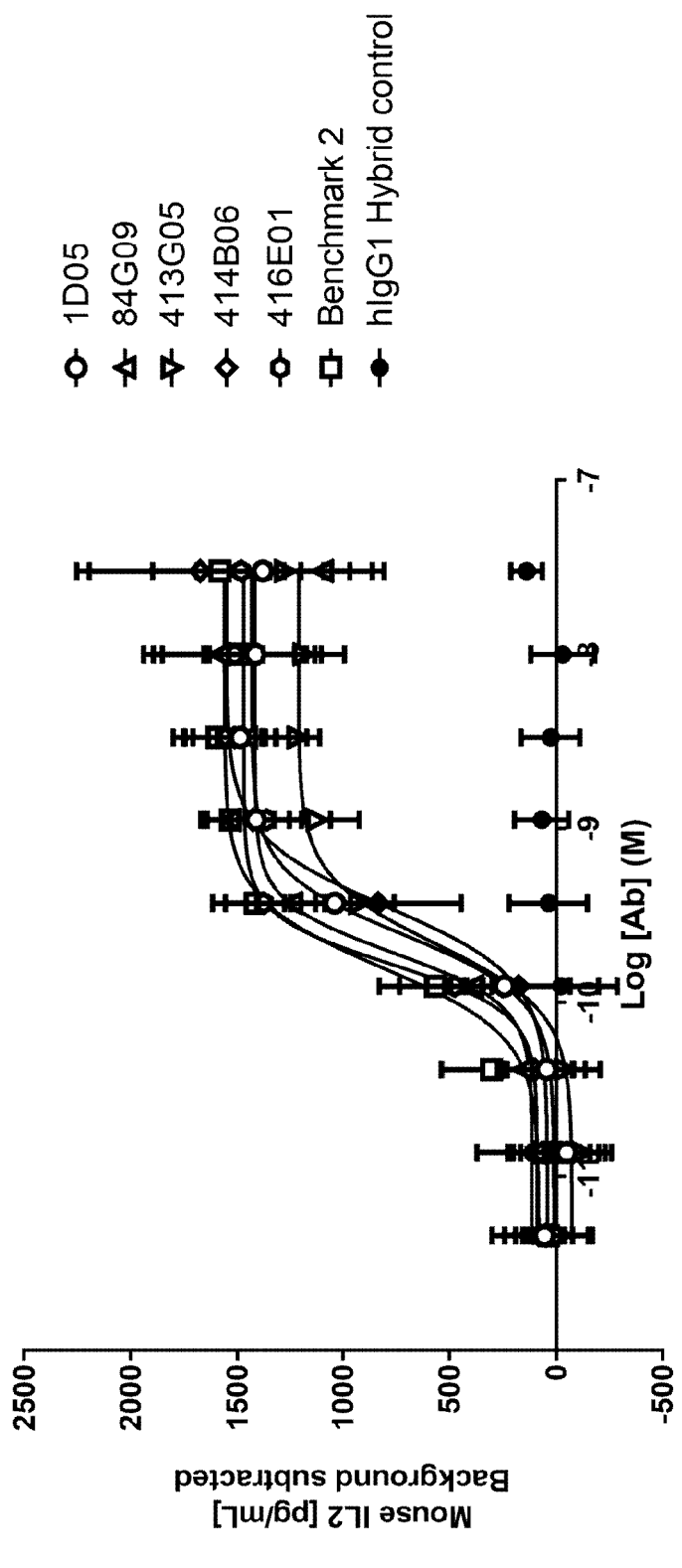
FIG. 23(a): Induction of IL-2 in a murine T-cell hybridoma assay. Human PD-L1 transfected LK35.2 cells were loaded with ovalbumin peptide and co-cultured overnight with DO-11-10 T-cell hybridoma cells in the presence of anti-PD-L1 antibodies or controls, prior to collection of supernatants and analysis of IL-2 release. Each data point indicates background-corrected mean IL-2 release from three independent experiments±standard deviation
Figure 23B:
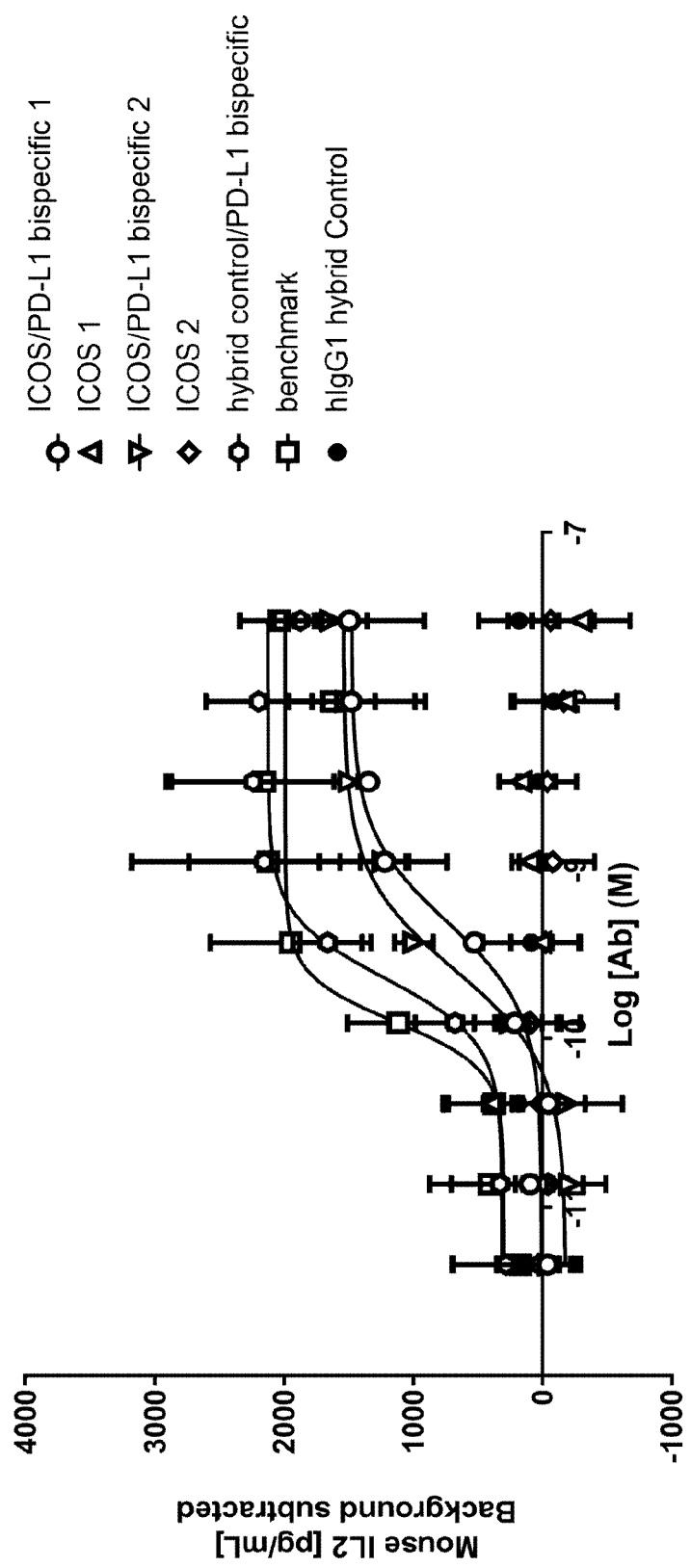
FIG. 23(b): Induction of IL-2 in a murine T-cell hybridoma assay. Human PD-L1 transfected LK35.2 cells were loaded with ovalbumin peptide and co-cultured overnight with DO-11-10 T-cell hybridoma cells in the presence of ICOS/PD-L1 bi-specific molecules, or individual antibodies, prior to collection of supernatants and analysis of IL-2 release. Each data point indicates background-corrected mean IL-2 release from three independent experiments±standard deviation

Mouse IL-2 quantification was performed using the mouse IL-2 Duoset ELISA kit (R&D Systems) following manufacturer's protocol, modified to include streptavidin-Europium as the detection reagent (DELFIA®). Briefly, assay plates were coated overnight at 4° C. with provided capture antibody prepared in PBS at 1 µg/mL. Plates were washed three times with PBS-Tween (0.1% v/v) before adding 200 µL of 1% w/v bovine serum albumin (BSA, Sigma) in PBS for 1 hour at room temperature. 50 µL cell supernatants were added to assay plates following a washing step performed as described previously. Following one hour incubation, 50 µL of provided detection antibody at 200 µg/mL prepared in 0.1% w/v BSA in PBS was added and plates were incubated for a further hour. Plates were washed as described above and 50 µL of DELFIA® Eu-N1 streptavidin diluted 1:500 from stock solution in DELFIA® assay buffer (Perkin Elmer) were added to all wells for 1 hour. An additional washing step was performed using DELFIA wash buffer (0.5 M Tris HCL (Gibco), 1% Tween v/v (Sigma)) before the addition of 50 µL DELFIA® Enhancement Solution (Perkin Elmer). The plate was incubated for 5 minutes at room temperature protected from the light and read at 615 nm using appropriate settings for DELFIA® time resolved fluorescence on an Envision plate reader (Perkin Elmer). The concentration of mouse IL-2 was interpolated from a standard curve run alongside test samples. Final plotted values were calculated using Equation 9, where background signal was calculated using assay signal of co-culture cells treated with 50 µL of media only. Results are shown in FIG. 23. All antibodies potently enhance production of IL-2 in this co-culture system.

Equation 9=Mouse IL-2 (pg/mL)−Background

TABLE 15

$EC_{50}$ values for induction of IL-2 by of PD-L1 antibodies in a murine T cell hybridoma assay

| Antibody name | $EC_{50}$ (nM) | | |
| --- | --- | --- | --- |
| | n = 1 | n = 2 | n = 3 |
| 1D05 | 0.33 | 0.21 | 0.21 |
| 84G09 | 0.24 | 0.14 | 0.17 |
| 413G05 | 0.29 | 0.11 | 0.29 |
| 414B06 | 0.59 | 0.30 | 0.18 |

TABLE 15-continued

EC$_{50}$ values for induction of IL-2 by of PD-L1
antibodies in a murine T cell hybridoma assay

| | EC$_{50}$ (nM) | | |
|---|---|---|---|
| Antibody name | n = 1 | n = 2 | n = 3 |
| 416E01 | 0.19 | 0.15 | 0.14 |
| benchmark 2 | 0.26 | 0.13 | 0.13 |

TABLE 16

EC$_{50}$ values for induction of IL-2 by ICOS/PD-
L1 bi-specific mAb$^2$ ™ antibodies
in a murine T cell hybridoma assay

| | EC$_{50}$ (nM) | | |
|---|---|---|---|
| Bispecific antibody name | n = 1 | n = 2 | n = 3 |
| ICOS/PD-L1 bispecific 1 | 0.386 | n/a | 0.888 |
| Hybrid Control/PD-L1 bispecific | 0.247 | 0.311 | 0.162 |
| ICOS/PD-L1 bispecific 2 | 0.338 | 0.217 | 0.229 |
| PD-L1 benchmark | 0.122 | 0.128 | 0.123 |

Figure 24A:
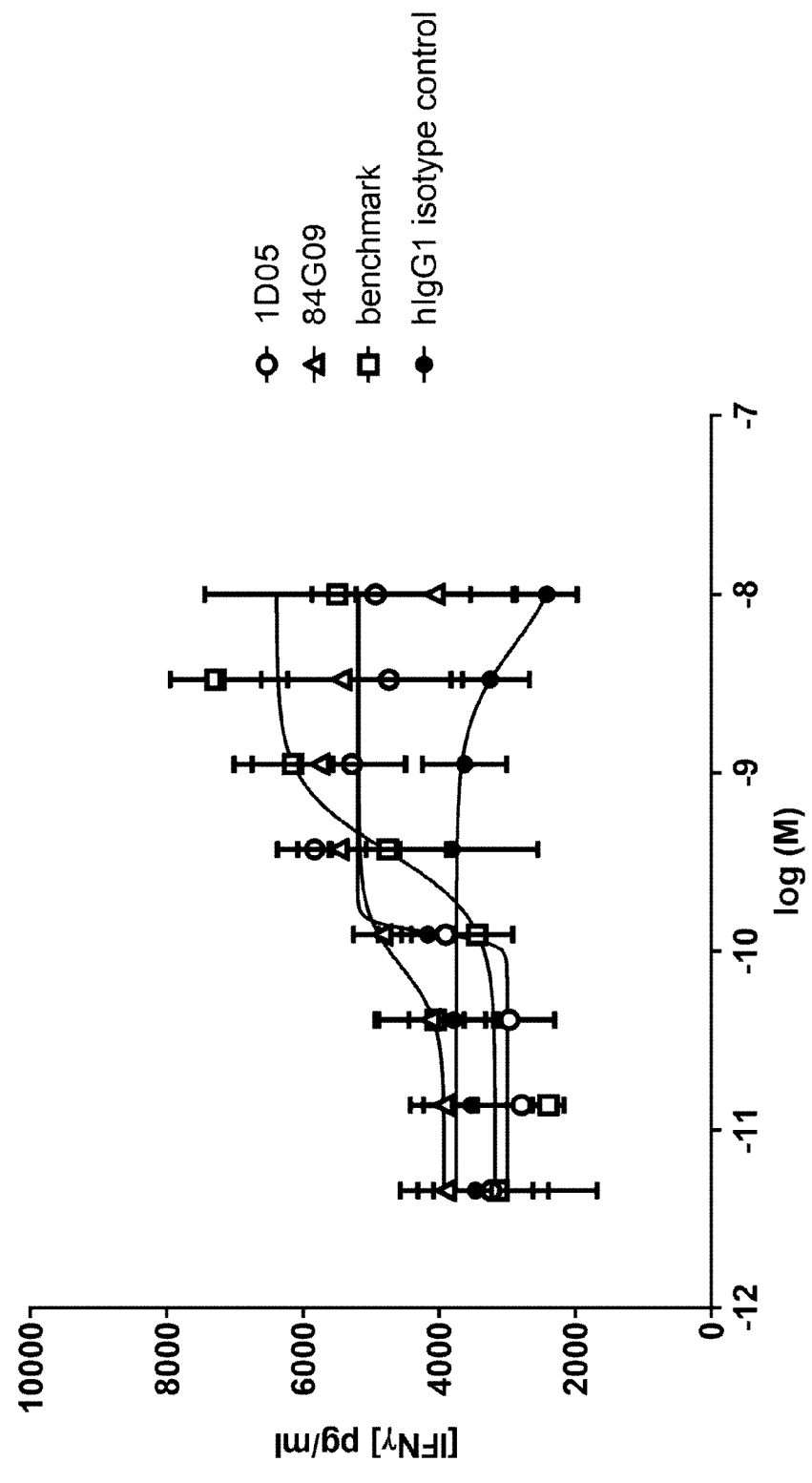
FIG. 24(a): Induction of IFNγ in a DC-T-cell MLR assay. Monocyte derived dendritic cells (DC) were activated with E. coli LPS and co-cultured with allogeneic CD3+ T-cells at a 1:1 ratio. IFNγ was measured by DELFIA assay after 5 days of co-culture. Data is from a single experiment
Figure 24B:
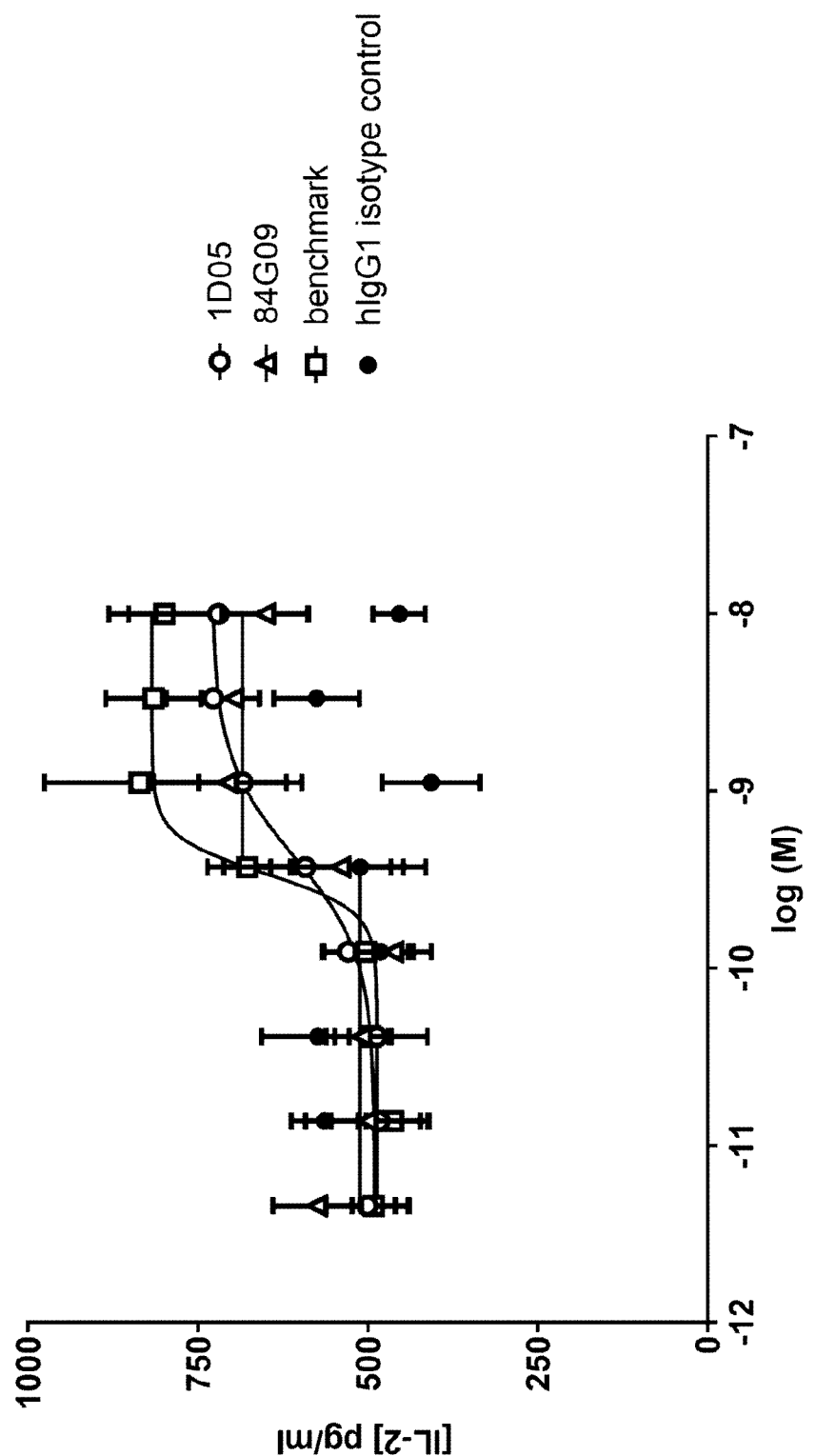
FIG. 24(b): Induction of IL-2 in a DC-T-cell MLR assay. Monocyte derived dendritic cells (DC) were activated with E. coli LPS and co-cultured with allogeneic CD3+ T-cells at a 1:1 ratio. IL-2 was measured by DELFIA assay after 3 days of co-culture. Data is from a single experiment

Example 25—Testing of Lead Antibodies in an
Activated DC—T-Cell Mixed Lymphocyte Reaction Monocytes were isolated from cryopreserved PBMCs by negative selection methods using a Monocyte Isolation Kit and the MACS™ magnetic separation system (Miltenyi Biotec). Monocytes were resuspended in RPMI 1640 medium containing 10% hiFBS and 100 ng/mL GM-CSF and IL-4 (both Peprotech). Cells were cultured for 5 days in non-TC treated 6-well plates (Greiner) to induce differentiation of DCs, before addition of 100 ng/mL lipopolysaccharide from *E. coli* 055:B5 (Sigma) to activate the DCs. Cells were harvested after 24 hours of activation, and washed once with PBS to remove LPS, and resuspended at 10$^6$/mL in RPMI 10% hiFBS. Allogeneic CD3$^+$ T-cells were isolated from cryopreserved PBMC using a Pan T-Cell Isolation kit and the MACS system as above, and resuspended at 2×10$^6$/mL in RPMI 10% hiFBS. Serial dilutions of selected antibodies (1:3) from 10 nM were prepared in RPMI 10% hiFBS and 50 µL added to 96-well, flat-bottomed TC plates plates in triplicate. DCs (100 µL) and T-cells (50 µL) were added to plates and incubated at 37° C., 5% C02 for five days. Supernatants were removed after three days for measurement of IL-2, and five days for measurement of IFNγ. Supernatants were stored at −20° C. until use. Cytokine production was measured with the R&D Systems Human IFNγ and IL-2 Duoset® ELISA, using DELFIA® Eu-N1 Streptavidin detection. Results are shown in FIG. 24.

Example 26—Multi-Dose Study of
Immunocytokines in Cynomolgus Monkeys

Pharmacology and toxicity of two immunocytokines, 1D05 D9-7 ICK and 1D05 D1-8 ICK (as described in Example 14), will be assessed in a multi-dose study in cynomolgus monkeys. Male juvenile monkeys are dosed with 1 mg/kg/dose according to two different regimens: Regimen 1—animals dosed on day 0 and day 14; regimen 2—animals dosed on day 0, 2, 14 and 16. Two animals will be dosed per group and monitored for 28 days. Treatment groups are shown in Table 17

TABLE 17

Treatment groups for multi-dose study

| Treatment group | Construct | Regimen | Animals per group |
|---|---|---|---|
| 1 | 1D05 D9-7 ICK | 1 | 2 |
| 2 | 1D05 D9-7 ICK | 2 | 2 |
| 3 | 1D05 D1-8 ICK | 1 | 2 |
| 4 | 1D05 D1-8 ICK | 2 | 2 |

Heart rate, body temperature, respiration rate and blood pressure will be measured 1 hour and 4 hours after dosing. Body weight will be monitored daily. Cytokines will be analysed on days 2, 5, 7, 10, 14, 16, 19, 21, 24 and 28, and pre-treatment. Haematology measurements will be performed on days 2, 5, 7, 10, 14, 16, 19, 21, 24 and 28, and pre-treatment. Detection of soluble CD25 will be performed on days 3, 7 and 10, 17, 21, 24, and pre-treatment. Immunophenotyping will be performed on days 7, 10, 14, 24 and 28, and pre-treatment, according to the panel described in Example 19. Samples for pharmacokinetic (PK) analysis will be taken at the following timepoints at each infusion: pre-treatment, end of infusion, and at 8, 16, 24, 32, 40, 48, 72, and 96 hours.

Example 27: Immunocytokine Efficacy Study in a
Syngeneic Tumour Model

An efficacy study will be performed using a CT-26 mouse tumour model, to compare surrogate immunocytokine activity with unmodified antibody, and to assess the role of effector function. On the day of implantation, BALB/c mice are injected subcutaneously into mice on the rear right flank with 1×10$^5$ CT-26 cells/animal. Treated groups will receive their first dose of antibody or relevant control (all dosed intraperitoneally at 10 mg/kg) 6 days post implantation of the tumour cells and will be dosed three times a week for a total of two weeks. Tumour development will be monitored three times a week using digital calipers measuring in two dimensions until end of the study. Tumour volumes (mm$^3$) will be estimated using a standard formula (L×W$^2$)/2 (with L being the larger diameter, and W the smaller diameter of the tumour). Mice are kept on studies until their tumours developed to a mean diameter of 12 mm or they reached the one humane endpoints outlined in the study protocol. The humane endpoint survival statistics will be calculated using the Kaplan-Meier method with Prism.

TABLE 18

Treatment groups for efficacy study

| Groups | Number of animals | Treatment |
|---|---|---|
| 1 | 10 | 10 mg/kg hybrid control huIgG1$_{LAGA}$ (constant region SEQ ID No: 205) |
| 2 | 10 | 10 mg/kg hybrid control huIgG1$_{LAGA}$ IL-2 |
| 3 | 10 | 10 mg/kg anti-PD-L1 huIgG1$_{LAGA}$ |
| 4 | 10 | 10 mg/kg anti-PD-L1 huIgG1$_{LAGA}$ IL-2 |
| 5 | 10 | 10 mg/kg anti-PD-L1 huIgG1 (constant region SEQ ID No: 340) |
| 6 | 10 | 10 mg/kg anti-PD-L1 huIgG1 IL-2 |

Example 28: Immunocytokine Efficacy Study in a
T-Cell: Melanoma Cell Line Xenograft Model An efficacy study will be performed using a T-cell: A375 cell line xenograft model in NOD/SCID mice employing a refinement of the methods outlined in R. Stewart et al. Briefly HLA-A2 positive donors are selected by staining whole blood using a PE labelled anti-human HLA-A2 antibody (Biolegend), followed by red blood cell lysis and analysis by flow cytometry. Primary human CD4' and CD8+ T-cells will then be isolated, using an EasySep human CD4+ or CD8+ T-cell enrichment kit, Stemcell Technologies, Cat 19052/3). The CD4+ and CD8+ cells are then cultured separately for 20 days on a monolayer of mitomycin C treated A375 cells in the presence of IL-2 and IL-7. T-cells are plated on a fresh feeder layer of A375 at day 10. On day 20, the cells are cryopreserved and stored in liquid nitrogen till required. The day before implantation, T-cells are thawed and cultured in medium plus cytokines overnight. On the day of implantation, the CD4+ and CD8+ cells are counted and mixed together in a 1:1 ratio. The T-cells are mixed with fresh A375 tumour cells at 1:6 ratio and injected subcutaneously into mice on the rear right flank. Treated groups will receive their dose of antibody, immunocytokine or relevant control (all dosed intraperitoneally at 10 mg/kg) one-hour post implantation of the T-cells and tumour cells. Tumour development will be monitored three times a week using digital calipers measuring in two dimensions until end of the study. Tumour volumes (mm³) will be estimated using a standard formula (L×W²)/2 (with L being the larger diameter, and W the smaller diameter of the tumour). Mice are kept on studies until their tumours developed to a mean diameter of 12 mm or they reached the one humane endpoints outlined in the study protocol. The humane endpoint survival statistics will be calculated using the Kaplan-Meier method with Prism. This approach will be used to determine which treatment is/are associated with improved survival. Subsequent studies will compare the immunocytokine constructs with different IL-2 activities.

TABLE 19

Treatment groups for efficacy study

| Groups | Number of animals | Treatment |
|---|---|---|
| 1 | 10 | 2 × 10⁶ A375 Cells |
| 2 | 10 | CD4+/CD8+ T cells: A375 Cells |
| 3 | 10 | 10 mg/kg hybrid control CD4+/CD8+ T cells: A375 Cells |
| 4 | 10 | 10 mg/kg hybrid control IL-2 CD4+/CD8+ T cells: A375 Cells |
| 5 | 10 | 200,000 IU recombinant human IL-2 CD4+/CD8+ T cells: A375 Cells (2 × 10⁶ A375 Cells) |
| 6 | 10 | 10 mg/kg 1D05 CD4+/CD8+ T cells: A375 Cells (2 × 10⁶ A375 Cells) |
| 7 | 10 | 10 mg/kg 1D05 LC IL-2 CD4+/CD8+ T cells: A375 Cells (2 × 10⁶ A375 Cells) |

Example 29: Activity of Lead Antibodies in a Reporter Assay of Effector Function The antibody-dependent cell-mediated cytotoxicity (ADCC) activity of selected antibodies was evaluated using an ADCC Reporter Bioassay. ES2 cells (ATCC CRL-1978) endogenously expressing human PD-L1 were co-incubated with effector cells (engineered Jurkat cells stably expressing human FcγRIIIa receptor—V158, Promega) that produce luciferase in a concentration-dependent manner in the presence of an ADCC-enabled antibody. The soluble luciferase activity is assessed by measuring the luminescence produced as the luciferase transformed a luminogenic substrate into a luminescent product.

Immediately prior to the assay, target cells (ES2) were centrifuged and resuspended in RPMI 1640+10% Ultra low IgG FBS (Thermo Fisher Scientific) and plated at 30,000 cells/well (10 µL/well) in 384-well white bottom plates. Jurkat NFAT luciferase reporter (effector) cells were resuspended in RPMI 1640+10% Ultra low IgG FBS and added to the target cells at 10,000 cells per well (10 µL/well). Eleven three-fold serial dilutions of antibodies were prepared from 2.2 nM in RPMI 1640+10% Ultra low IgG FBS and added to the target cells (10 µL/well). The plates were incubated overnight at 37° C., 5% $CO_2$, after which a luminogenic BioGlo substrate was added directly to the wells (30 µL/well) and luminescence quantified on an Envision (Perkin Elmer) plate reader.

Relative light unit (RLU) values from the raw data (Envision reads) were normalised to 'Fold of induction using the following equation:

$$\text{fold of induction} = \frac{(RLU \text{ (induced)} - RLU \text{ (background)})}{RLU \text{ (background)}} \quad \text{Equation 10}$$

Figure 34:
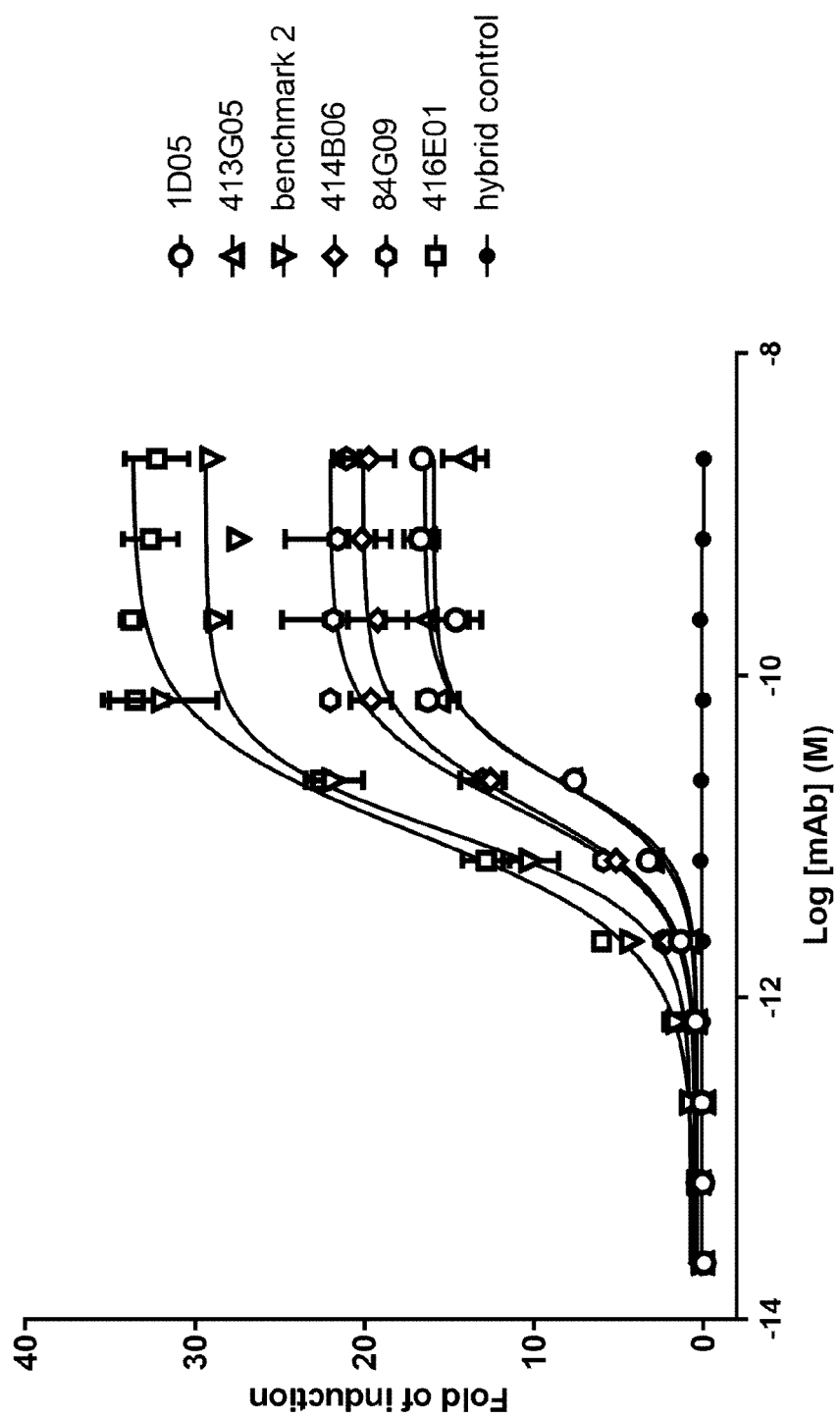
FIG. 34: Effector function of lead antibodies in a reporter cell assay. PD-L1 expressing target cells (ES2) were co-cultured overnight with Jurkat cells, engineered to express NFAT-induced luciferase and FcγRIIIa, in the presence of PD-L1 antibodies. Each data point indicates mean fold induction of relative light units±standard deviation. Data is from one representative experiment, of three independent experiments

Data was plotted in GraphPad Prism, using a 4-parameter logistic fit, and a representative experiment is shown in FIG. 34. Results are summarised in Table 20. All antibodies tested induced luminescence, suggesting that all have the capacity to induce killing of target cells by ADCC. Although $EC_{50}$ values are generally similar, 416E01 induces a highest maximum level of luminescence.

TABLE 20

Summary of data from reporter cell assay

| Antibody name | $EC_{50}$ (pM) | | | max fold induction | | |
|---|---|---|---|---|---|---|
| | n = 1 | n = 2 | n = 3 | n = 1 | n = 2 | n = 3 |
| 1D05 | 24.14 | 21.53 | 34.71 | 13.70 | 16.69 | 25.04 |
| 84G09 | 24.95 | 15.30 | 25.90 | 16.33 | 22.21 | 33.82 |
| 413G05 | 21.92 | 20.87 | 27.52 | 13.22 | 16.41 | 23.45 |
| 414B06 | 19.08 | 15.02 | 24.24 | 10.94 | 20.15 | 31.51 |
| 416E01 | 79.98 | 10.58 | 22.86 | 32.11 | 33.76 | 60.16 |
| benchmark 2 | 24.81 | 10.56 | 24.93 | 19.55 | 31.88 | 43.23 |

Example 30: Binding of Lead Antibodies to Cell-Expressed Cynomolgus PD-L1

Figure 35:
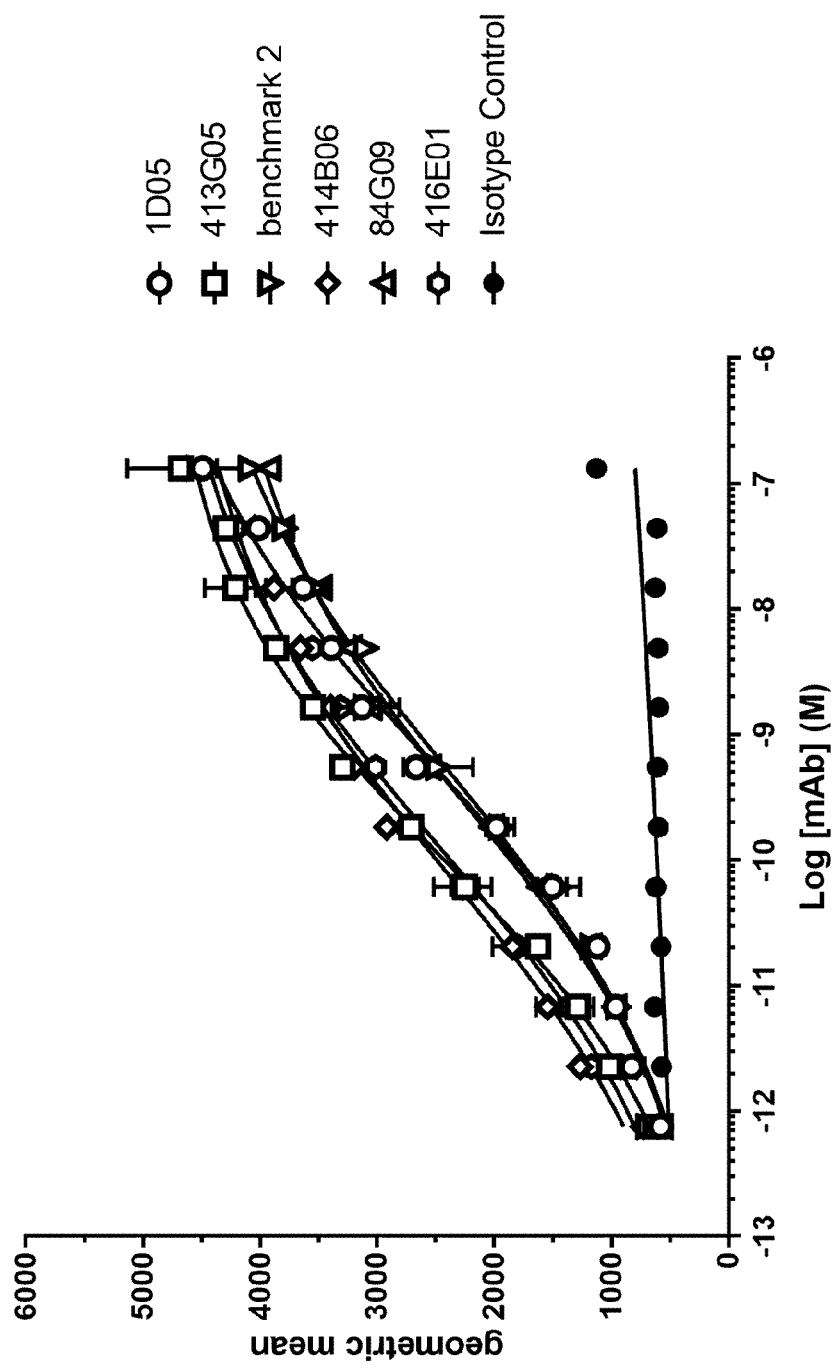
FIG. 35: Binding of lead antibodies to cell-expressed cynomolgus PD-L1. Antibodies were titrated on CHO cells expressing cynomolgus PD-L1, and bound antibody detected with an anti-human IgG AlexaFluor 647. Data is from a single experiment

CHO-S cells transfected with cynomolgus PD-L1 were diluted in FACS buffer (PBS+1% w/v BSA+0.1% w/v sodium azide) and were distributed to a 96-well V-bottom plate (Greiner) at a density of 1×10⁵ cells per well. Antibody titrations were prepared from 133 nM working concentration as a 1/3 dilution series in FACS buffer. Plates were centrifuged at 300×g for 3 minutes and supernatant aspirated. 50 µL per well of antibody titrations were added to cells and incubated at 4° C. for 1 hour. Cells were washed with 150 µL of PBS and centrifuged at 300 g for 3 minutes. Supernatant was aspirated and 150 µL PBS added per well. This wash step was repeated. Presence of bound antibody was detected by addition of 50 µL per well of anti-Human IgG AlexaFluor 647 (Jackson ImmunoResearch) diluted 1/500 in FACS buffer. Cells were incubated for 1 hour at 4° C. in the dark. Cells were washed as previously described. To fix cells, 50 µL per well of 4% v/v paraformaldehyde was added and cells incubated for 20 minutes at 4° C., cells were pelleted by centrifugation at 300×g and the plates resuspended in 75 µL PBS. Geometric mean was measured by flow cytometry using a Beckman Coulter CytoFLEX instrument. Alexa Fluor 647 was excited by a 637 nm laser and detected in the Red channel with a 660/20 bandpass filter. Data was analysed using FlowJo software and is shown in FIG. 35. All antibodies bind to cynomolgus PD-L1 expressed on cells.

Example 31: Binding to CHO-Expressed hPD-L1 and Neutralisation of hPD-L1 Binding to PD-1 and CD80

CHO cells untransfected (referred to as WT) or transfected with hPD-L1 expressing recombinant human PD-L1 were diluted in FACS buffer (PBS 1% BSA 0.1% sodium azide) and distributed to three 96-well, V-bottom plate (Greiner) at a density of $1\times10^5$ cells per well. Cells are washed with 150 µL PBS and centrifuged at 300 g for 3 minutes. Supernatant is aspirated and 150 µL PBS added. This wash step is repeated.

To plate 1 (PD-L1 binding), lead antibody, reference antibody or control antibody titrations were prepared from 150 nM working concentration as a 1/3 dilution series in FACS buffer. 50 µL of antibody diluted in FACS buffer is added to the washed cells and incubated at 4° C. for 60 minutes. 150 µL FACS buffer is added and cells washed as described above. To detect anti-PD-L1 antibody binding, anti-human PE (Jackson ImmunoResearch) is diluted 1/500 in FACS buffer and 50 µL of this mixture added to cells. Cells are incubated 4° C. for 60 minutes. Cells are washed twice with 150 µL FACS buffer, centrifuging at 300 g for 3 minutes after each wash step and aspirating supernatant. Cells are fixed by addition of 100 µL 4% paraformaldehyde and 30 mins at 4° C. Cells are washed once as above and resuspended in 100 µL FACS buffer for analysis. PE signal intensity (geometric mean) is measured by flow cytometry using a Beckman Coulter Cytoflex instrument. Data is plotted as geometric mean values without further calculation.

To plate 2 (PD-1 neutralisation), biotinylated human PD-1-Fc (in-house expressed, Seq ID No:6) were prepared as a titration from 1 µM final assay concentration (FAC), 1/2 dilution series in FACS buffer. Lead antibody, reference antibody or control antibody titrations were prepared from 300 nM working concentration, 150 nM FAC, as a 1/3 dilution series in FACS buffer. Biotinylated PD-1 were diluted in FACS buffer to 60 nM working concentration, 30 nM FAC. 25 µL PD-1 and 25 µL antibody solution (or 50 µL of PD1 titration) were added to cells and incubated at 4° C. for 1 hour. Biotinylation is performed in-house using Lightning Link conjugation kit (Innova Biosciences) according to manufacturer's instructions. 150 µL FACS buffer is added and cells washed as described above. To detect biotinylated PD-1, Streptavidin-Alexa Fluor 647 (AF647, Jackson ImmunoResearch) is diluted 1/500 in FACS buffer and 50 µL of this mixture added to cells. Cells are incubated at 4° C. for 60 minutes. Cells are washed twice with 150 µL FACS buffer, centrifuging at 300 g for 3 minutes after each wash step and aspirating supernatant. Cells are fixed, washed and resuspended for analysis as above. APC signal intensity (geometric mean) is measured by flow cytometry using a Beckman Coulter CYTOFLEX instrument. Data is plotted as percentage of receptor binding.

To plate 3 (CD80 neutralisation) Biotinylated human CD80 (Fc tagged, R&D Systems, 140-B1) were prepared as a titration from 1 µM final assay concentration (FAC), 1/2 dilution series in FACS buffer. Lead antibody, reference antibody or control antibody titrations were prepared from 300 nM working concentration, 150 nM FAC, as a 1/3 dilution series in FACS buffer. Biotinylated CD80 were diluted in FACS buffer to 60 nM working concentration, 30 nM FAC. 25 µL CD80 and 25 µL antibody solution (or 50 µL of CD80 titration) were added to cells and incubated at 4° C. for 1 hour. All other steps are performed as per plate 2.

Percentage of receptor binding (flow cytometry)

Based on geometric mean fluorescence $$\% \text{ of specific binding} = \frac{\text{sample value} - \text{non-specific binding}}{\text{total binding} - \text{non-specific binding}} \times 100 \quad \text{Equation 11}$$

Total binding = biotinyled PD-1 or CD80 only
(Hybrid Control at 150 nM FAC)
Non-specific binding = no PDL1 binding,
(benchmark 2 at 150 nM FAC)

Figure 36A:
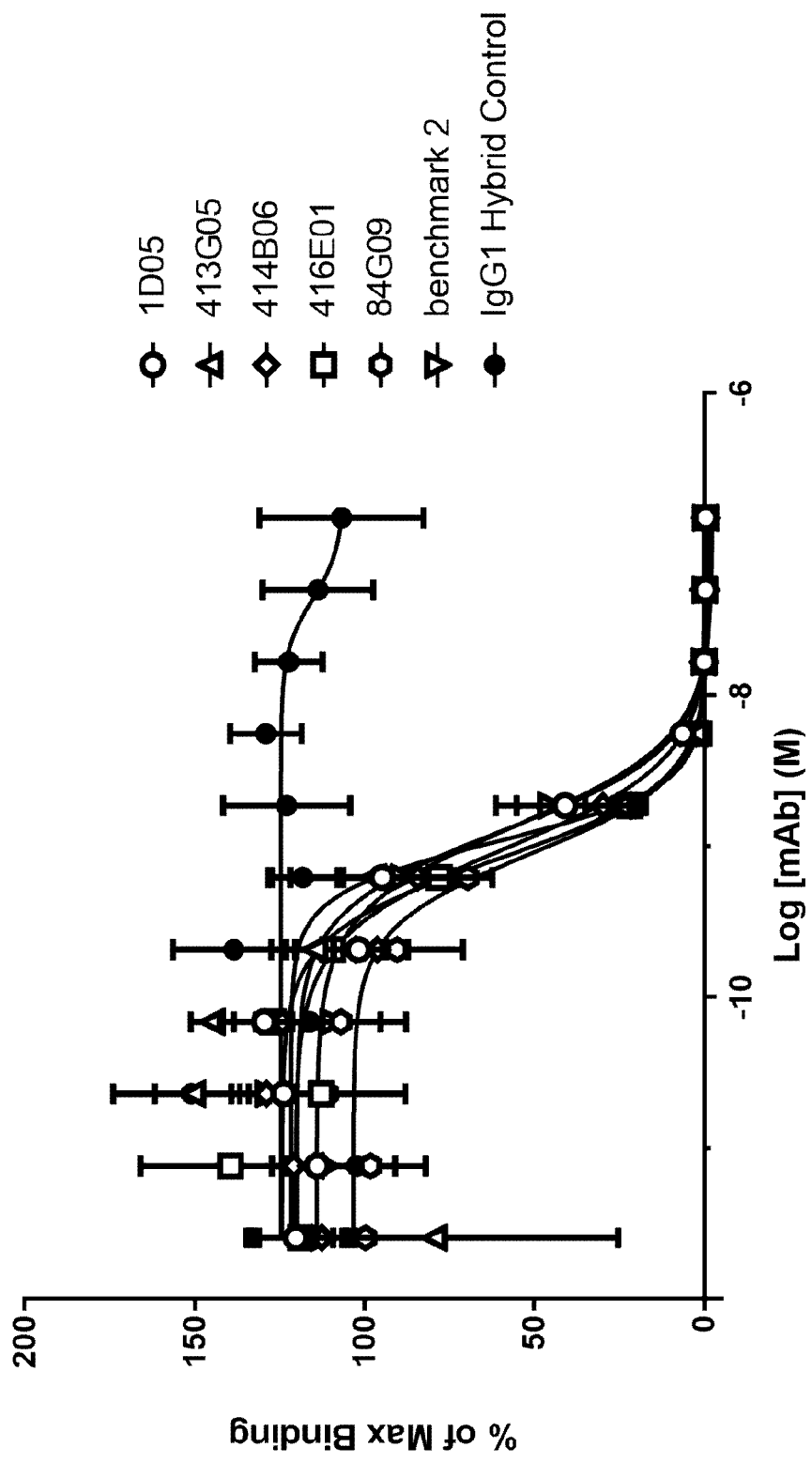
FIG. 36(a): Human PD-L1 CHO-S FACS neutralisation with PD-1 receptor. Neutralisation profiles of lead antibodies compared to a benchmark anti-PD-L1 antibody and isotype control. Data representative of two independent experiments
Figure 36B:
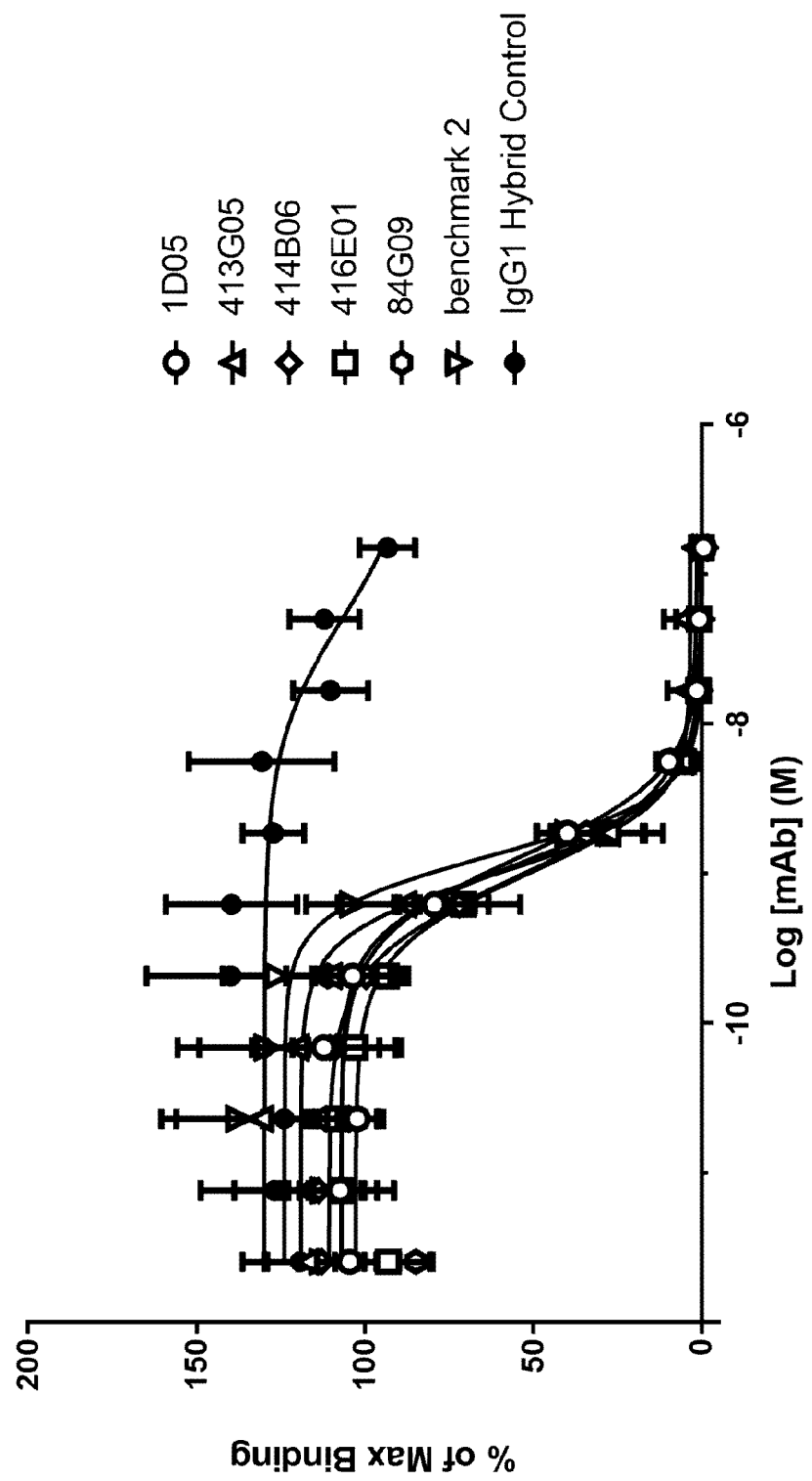
FIG. 36(b): Human PD-L1 CHO-S FACS neutralisation with CD80 receptor. Neutralisation profiles of lead antibodies compared to a benchmark anti-PD-L1 antibody and isotype control. Data representative of two independent experiments

Results are shown in FIG. 36 and in Table 21. All lead antibodies neutralise interactions of PD-L1 with both PD-1 and CD80.

TABLE 21

Summary of neutralisation of PD-1 and CD80 interactions with PD-L1

| Antibody | PD-1 IC$_{50}$ (nM) | | CD80 IC$_{50}$ (nM) | |
|---|---|---|---|---|
| name | n = 1 | n = 2 | n = 1 | n = 2 |
| 1D05 | 1.27 | 1.46 | 1.15 | 1.46 |
| 84G09 | 0.89 | 1.41 | 1.11 | 1.41 |
| 413G05 | 1.07 | 1.17 | 1.09 | 1.17 |
| 414B06 | 0.95 | 1.22 | 1.26 | 1.22 |
| 416E01 | 0.81 | 0.89 | 1.04 | 0.89 |
| benchmark 2 | 1.36 | 1.46 | 1.27 | 1.46 |

Example 32: Effector Function of Lead Antibodies in a Primary NK Cell ADCC Assay Activity of antibodies to kill PD-L1 expressing target cells via ADCC (antibody-dependent cell-mediated cytotoxicity) is measured by DELFIA cytotoxicity assay (Perkin Elmer) using human primary NK cells as effectors and ES2 as PD-L1+ target cells.

This method is based on loading target cells with an acetoxymethyl ester of fluorescence enhancing ligand (BATDA) which quickly penetrates the cell membrane. Within the cell the ester bonds are hydrolysed to form a hydrophilic ligand (TDA) which no longer passes the membrane. After cytolysis the ligand is released and can be detected by addition of Europium which forms with the BATDA a highly fluorescent and stable chelate (EuTDA). The measured signal correlates directly with the degree of cell lysis.

ES2 cells are resuspended at $10^6$/mL in assay medium (RPMI+10% ultra-low IgG FBS, from Gibco) and loaded with 5 μL/mL of BATDA reagent (Perkin Elmer) for 30 min at 37° C. Cells were then washed 3 times with 50 mL PBS (300× g for 5 min) and resuspended at $8 \times 10^5$/mL in assay medium supplemented with 2 mM Probenecid (Life technologies) to reduce BATDA spontaneous release from the cells. Supernatant from ES2 cells immediately after final resuspension in assay medium is used as background control.

Seven serial three-fold dilutions of PD-L1 antibodies and isotype controls are prepared in assay media+2 mM Probenecid from 4 μg/mL (4× final concentration). NK cells are negatively isolated from fresh PBMC using Human NK Cell Isolation Kit (Miltenyi Biotec) as per manufacturer's instructions and resuspended at $4 \times 10^6$/mL in assay medium+2 mM Probenecid. 50 μL of diluted Ab, 50 μL of BATDA loaded target cells, 50 μL of NK cells and 50 μL of assay medium+2 mM Probenecid (final volume of 200 μL/well) are added in each well to give an effector: target ratio of 5:1. Wells containing ES cells only or ES2 cells+ DELFIA lysis buffer (Perkin Elmer) are used to determine spontaneous and maximum release, respectively.

Cells are incubated at 37° C., 5% $CO_2$ for 4 hours before centrifugation of plates for 5 min at 500×g, and transfer of 50 μL of cell-free supernatant into a DELFIA microtitration Plates (Perkin Elmer). 200 μL of DELFIA Europium solution (Perkin Elmer) was added to the supernatants and incubated for 15 min at Room Temperature. Fluorescent signal was then quantified with an EnVision plate reader (PerkinElmer).

Background counts are subtracted from all experimental counts. Specific release is calculated according to the following equation:

$$\% \text{ specific release} = \frac{(\text{experimental release} - \text{spontaneous release})}{(\text{maximum release} - \text{spontaneous release})} \times 100 \quad \text{Equation 12}$$

Example 33—TIGIT: Generation of Tool Reagents

The following example provides a detailed description of the generation of reagents used for immunisation and development of in vitro assays for screening and lead antibody characterisation.

Materials and Methods a) Cloning and Expression of Recombinant Proteins

Recombinant proteins were generated in house using human and cyno TIGIT published nucleotide sequences (respectively Seq ID No: 542 and 553, which were cloned into appropriate mammalian expression vectors for transient expression in HEK 293 or CHO cells. The same methodology was used to produce human CD155 (Seq ID No: 572). Sequences of expressed antigens including affinity tags used for purification are detailed in sequence listing table when available: see Seq ID No: 539 and 545 (human TIGIT), Seq ID No: 554 and 555 (cyno TIGIT) and Seq ID No: 573 and 574 (human CD155).

b) Generation of Stably Transfected CHO and HEK 293 Cells Expressing Human and Mouse TIGIT:

Full length human (Seq ID No: 543) and mouse TIGIT sequences (Seq ID No: 558) were codon optimized for mammalian expression and cloned into an expression vector under the CMV promoter flanked by 3' and 5' piggyBac specific terminal repeat sequences, facilitating stable integration into the cell genome (see: "A hyperactive piggyBac transposase for mammalian applications"; Yusa K., et al., Proc. Natl. Acad. Sci. USA., 108(4): 1531-6, 2011 Jan. 25).

Furthermore, the expression vector contained a puromycin selection cassette to facilitate stable cell line generation. The human and mouse expression plasmids were co-transfected with a plasmid encoding piggyBac transposase into HEK 293 and CHO-S cell lines using the FreeStyle Max transfection reagent (Invitrogen) per manufacturer instructions. 24 hours after transfection, the media was supplemented with puromycin and grown for at least two weeks to select a stable cell line with media being exchanged every 3 to 4 days. Confirmation of target expression on cells was investigated by flow cytometry using anti-human (R&D Systems, Catalogue number MAB7898) and anti-mouse (Biolegend, Catalogue number 142102) TIGIT commercial antibodies.

Example 34—TIGIT: Immunisation and B-Cell Sorting Campaigns

This example describes in detail methods for immunisation and B-cell sorting campaigns for the generation of human anti-TIGIT antibodies using the KyMouse™ system (see, e.g., WO2011/004192, WO2011/158009 and WO2013/061098). To this end, genetically engineered mice containing a large number of human immunoglobulin genes were immunized following a number of regimens, including conventional intraperitoneal injections as well as a rapid immunisation at multiple sites (RIMMS; modified after Kilpatrick et al., ("Rapid development of affinity matured monoclonal antibodies using RIMMS"; Hybridoma. 1997 August; 16(4):381-9) (see detailed methods below). Immunisations were carried out using recombinant proteins (human and/or mouse TIGIT), HEK 293 cells (expressing human or mouse TIGIT) or a combination of both.

Immune response to conventional immunisation regimes (KM091, KM101 and KM116) was determined by DELFIA® Time-resolved fluorescence and on occasions also by flow cytometry using samples taken following prime and two protein and/or cell boosts. RIMMS immunised mice (KM115 and KM127) were sacrificed without indication of immune response prior sorting. At the end of each regime, secondary lymphoid tissue such as the spleen, and in some cases, the lymph nodes were removed. Tissues were prepared into a single cell suspension for sorting of antigen specific B-cells.

a) Immunisations

Genetically engineered HK and HL Kymouse™ strains, containing human immunoglobulin genes producing human kappa (HK) and lambda (HL) light chain antibodies (Lee et al., Nature Biotechnology, 32, 6-363, 2014) were immunized as summarised in Table 23.

TABLE 23

Immunisation campaigns

| Immunisation | Animals immunised | Antigen | Regime* |
|---|---|---|---|
| KM091 | 1) 3x HL + 3x HK 2) 3x HL + 3x HK | 1) human TIGIT-Fc (Seq ID No: 545 or 546) 2) flip-flop using human TIGIT-Fc (Seq ID No: 545 or 546) and mouse TIGIT-Fc (Seq ID No: 561) | Conventional |
| KM101 | 1) 3x HL + 3x HK 2) 3x HL + 3x HK | 1) flip-flop using human TIGIT-Fc (Seq ID No: 545) and human TIGIT HEK 293 cells (Seq ID No: 543) 2) flip-flop using mouse TIGIT-Fc (Seq ID No: 561) and human TIGIT HEK 293 cells (Seq ID No: 543) | Conventional |

TABLE 23-continued

Immunisation campaigns

| Immunisa-tion | Animals immunised | Antigen | Regime* |
|---|---|---|---|
| KM115 | 2x HK v2.1 + 2x HL v2.1 2x HK v2.1 + 2x HL v2.1 | 1) human TIGIT-His/Flag (Seq ID No: 539) 2) co-administration of human TIGIT-His/Flag (Seq ID No: 539) and mouse TIGIT-His (Seq ID No: 560) | RIMMS |
| KM116 | 2x HK v2.1 + 2x HL v2.1 | 1 immunisation arm using cells only Prime and Boost 1 co-administration of human (Seq ID No: 543) and mouse TIGIT HEK 293 cells (Seq ID No: 558); human HEK 293 cells delivered for boost 2, 3 and 4. | Conventional |
| KM127 | 3x HK v2.1 + 3x HL v2.1 | 1) mouse TIGIT-His (Seq ID: 560) | RIMMS |

*Conventional regime: prime followed by 4 boosts with 3 weeks' intervals; RIMMS: prime followed by 6 boots administrated over 2 weeks b) Determining Serum Titres by DELFIA® Time-Resolved Fluorescence Goat anti-mouse IgG capture antibody (Southern Biotech), prepared at 4 µg/mL in PBS, was added to high protein binding 96-well plates (Costar) (50 µL/well) and incubated overnight at 4° C. Next day excess IgG was removed by washing three times with PBS Tween (0.1% v/v) before wells were blocked with 1% w/v bovine serum albumin (BSA, Sigma) in PBS for 1 hour at room temperature. Following this blocking step, plates were washed again with PBS-Tween (0.1% v/v). Mouse serum samples were initially diluted 1:100 and titrated 1:10 in dilution buffer (0.1% w/v BSA in PBS) to generate an 8-point curve before addition to assay plates (50 µL/well). Anti-human TIGIT (R&D, Catalogue number MAB7898) and anti-mouse TIGIT (Biolegend, Catalogue number 142102) antibodies were titrated from 2 µg/ml using a 3-fold dilution series for a 11-point standard curve. Following 1 hour incubation at room temperature, plates were washed as detailed previously. 50 µL/well of biotinylated human (Seq ID No: 539 and 546) or mouse TIGIT (Seq ID No: 560 and 561), labelled in house using Sulfo-NHS-LC-Biotin (Thermo) was then added at 0.1 µg/ml to plates and incubated for 1 hour at room temperature. Excess biotinylated human/mouse TIGIT was removed by washing with PBS-Tween (0.1% v/v) before the addition of streptavidin-europium (Perkin Elmer) diluted 1/1000 in DELFIA® Assay Buffer (Perkin Elmer). Following 1 hour incubation at room temperature, plates were washed before the addition of 50 µL DELFIA® Enhancement Solution (Perkin Elmer). Plates were incubated for 5 minutes protected from light and read at 615 nm using appropriate settings for DELFIA® Time resolved fluorescence on an Envision plate reader (Perkin Elmer). Data was plotted onto Prism for analysis of responses for pre- and post-immunisation samples.

c) Determining Serum Titres by Flow Cytometry

Mouse serum samples were titrated in FACS buffer (PBS+ 1% w/v BSA+0.1% w/v sodium azide) as described in the previous methods section, as were antibody controls, validated for flow cytometry, binding to human (R&D Systems, Catalogue number MAB7898) or mouse TIGIT (eBiosciences, Catalogue number 12-9501-82). Control standard curves were composed of 11 points titrated 3-fold from 5 µg/mL and 20 µg/mL starting concentration for human and mouse reference antibodies respectively. Human TIGIT (Seq ID No: 543) and mouse TIGIT (Seq ID No: 558) CHO-S cells prepared at 4×10$^6$ cells/mL were added to 96-well, v-bottom plates (Greiner) and pelleted following three washing steps in FACS buffer. 25 µL/well of each sample and controls were incubated with cells for one hour at 4° C. Cells were washed as described before adding 50 µL/well Alexa Fluor 647 AffiniPure Goat anti-Mouse IgG Fcγ Fragment Specific (Jackson ImmunoResearch) or Alexa Fluor 647 AffiniPure Goat Anti-Rat IgG (H+L) (Jackson ImmunoResearch), diluted 1:500 in FACS buffer. Following 30-minute incubation at 4° C. in the dark, cells were washed, pelleted and re-suspended in 4% paraformaldehyde (Affymetrix) for 20 minutes. Final washing step removed fixing solution before re-suspending cells in 100 µL FACS buffer. Flow cytometry was performed using BD FACS Array instrument and Kaluza® to quantify 647 geometric mean of each sample. Quantification of response to immunisation was performed by comparing assay signal of samples collected pre- and post-immunisation to assess whether a target specific response and not directed to cells had been raised.

d) B-Cell Sorting

B-cell sorting was performed as previously described in Example 1 of PCT application WO2015/040401. In brief, splenocytes and lymph node cells, if following RIMMS immunisations, were isolated from immunised mice and stained with an antibody cocktail containing markers for the selection of B-cells (CD19) and exclusion of unwanted cells (IgM, IgD, 7AAD). CD19$^+$ B-cells specific to target were sorted by detecting binding to human TIGIT-647 (Seq ID No: 539 or Seq ID No: 546) and mouse TIGIT-488 (Seq ID No: 560), (in-house labelling using Lightning Link™ kits). Gating strategy was designed in a way that cells binding to human TIGIT, mouse TIGIT or both were single cell sorted by flow cytometry into lysis buffer. V-region sequences were recovered using RT-PCR and two further rounds of PCR, then bridged to mouse IgG1 constant region and expressed in HEK 293 cells. Supernatants from HEK 293 cells were screened for the presence of TIGIT binding antibodies. This method is hereafter referred to as BCT. A summary of the sorting campaigns is detailed in Table 24, which includes the number of sorted and transfected plates and total number of clones screened in downstream assays.

TABLE 24

B-cell sorting campaigns

| Sorting | Sorted plates | Transfected plates | Screened clones |
|---|---|---|---|
| KM091-B1 | 18 | 16*82 wells | 1372 |
| KM091-B2 | 27 | 2*82 wells 1*56 wells | 220 |
| KM101-B1 | 24 | 23*82 wells | 1886 |
| KM101-B2 | 11 | 9*82 wells 1*73 wells 1*52 wells | 863 |
| KM115-B1 | 12 | 12*82wells | 984 |
| KM116-B1 | 16 | 15*82 wells 1*67 wells | 1297 |
| KM127-B1 | 24 | 14*82 wells | 1148 |

Example 35—TIGIT: BCT Primary Screening

The following example details assays and selection process used to identify panel of primary hits. HTRF® (Homogeneous Time-Resolved Fluorescence, Cisbio) assays were set up to detect antibodies in BCT supernatants able to bind to human (Seq ID No: 539), mouse (Seq ID No: 560 and 561) and cyno TIGIT (Seq ID No: 554) and block interaction of target to human CD155 (Seq ID No: 575). Screening of KM091-B1 BCT supernatants also included checking of binding to human TIGIT (Seq ID No: 543) on cells and binding to mouse TIGIT recombinant protein (Seq ID No: 560) by DELFIA® Time-resolved Fluorescence.

Assays and working concentrations used for each screening are listed in Table 25. Concentration of reagents was on occasions adjusted to optimise assay to different batches of proteins used. Table 25 also informs of cut-offs applied to select clones to re-test in secondary screening assays.

TABLE 25

Assays and criteria for primary hit selection

| Campaign | Assay | Protein ID | Working concentrations | % Effect cut-off |
|---|---|---|---|---|
| KM091 - B1 | HTRF - binding to human TIGIT | Human TIGIT-His/Flag (Seq ID No: 539) | 15 nM | >5% |
| | HTRF - Human TIGIT/CD155 neutralisation | Human TIGIT-Fc (Seq ID No: 545) Human CD155-His (Seq ID No: 575) | 7.5 nM 12.5 nM | <70% |
| | ELISA - binding Mouse TIGIT | Mouse TIGIT-His (Seq ID No: 560) | 0.5 µg/mL | Mean + 3 * Standard deviation negative control |
| KM091-B2 | HTRF - binding to human TIGIT | Human TIGIT-His/Flag (Seq ID No: 539) | 15 nM | >5% |
| | HTRF - binding to mouse TIGIT | Mouse TIGIT-His (Seq ID No: 560) | 5 nM | >5% |
| | HTRF - binding to Cyno TIGIT | Cyno TIGIT-Flag/His (Seq ID No: 554) | 15 nM | >10% |
| | HTRF- Human TIGIT/CD155 neutralisation | Human TIGIT-Fc (Seq ID No: 545) Human CD155-His (Seq ID No: 575) | 0.25 nM 1 nM | <65% |
| KM101-B1 | HTRF - binding to human TIGIT | Human TIGIT-His/Flag (Seq ID No: 539) | 15 nM | >10% |
| | HTRF - binding to mouse TIGIT | Mouse TIGIT-His (Seq ID No: 560) | 5 nM | Mean + 3 * Standard deviation negative control |
| | HTRF - binding to Cyno TIGIT | Cyno TIGIT-Flag/His (Seq ID No: 554) | 15 nM | >10% |
| | HTRF- Human TIGIT/CD155 neutralisation | Human TIGIT-Fc (Seq ID No: 545) Human CD155-His (Seq ID No: 575) | 0.25 nM 1 nM | <65% |
| KM101-B2 | HTRF - binding to human TIGIT | Human TIGIT-His/Flag (Seq ID No: 539) | 15 nM | >5% |
| | HTRF- binding to mouse TIGIT | Mouse TIGIT-His (Seq ID No: 560) | 5 nM | >5% |
| | HTRF - binding to Cyno TIGIT | Cyno TIGIT-Flag/His (Seq ID No: 554) | 15 nM | >5% |
| | HTRF- Human TIGIT/CD155 neutralisation | Human TIGIT-Fc (Seq ID No: 545) Human CD155-His (Seq ID No: 575) | 0.25 nM 1 nM | <70% |
| KM115-B1 | HTRF - binding to human TIGIT | Human TIGIT-His/Flag (Seq ID No: 539) | 15 nM | >5% |
| | HTRF - binding to mouse TIGIT | Mouse TIGIT-His (Seq ID No: 560) | 5 nM | >5% |
| | HTRF - binding to Cyno TIGIT | Cyno TIGIT-Flag/His (Seq ID No: 554) | 15 nM | >5% |
| | HTRF- Human TIGIT/CD155 neutralisation | Human TIGIT-Fc (Seq ID No: 545) Human CD155-His (Seq ID No: 575) | 0.25 nM 1 nM | <70% |
| KM116-B1 | HTRF - binding to human TIGIT | Human TIGIT-His/Flag (Seq ID No: 539) | 15 nM | >5% |
| | HTRF - binding to mouse TIGIT | Mouse TIGIT-His (Seq ID No: 560) | 5 nM | >10% |
| | HTRF - binding to Cyno TIGIT | Cyno TIGIT-Flag/His (Seq ID No: 554) | 15 nM | >5% |
| | HTRF- Human TIGIT/CD155 neutralisation | Human TIGIT-Fc (Seq ID No: 545) Human CD155-His (Seq ID No: 575) | 0.25 nM 1 nM | <70% |
| KM127-B1 | HTRF - binding to human TIGIT | Human TIGIT-His/Flag (Seq ID No: 539) | 15 nM | >5% |
| | HTRF - binding to mouse TIGIT | Mouse TIGIT-His (Seq ID No: 560) | 5 nM | >5% |
| | HTRF - binding to Cyno TIGIT | Cyno TIGIT-Flag/His (Seq ID No: 554) | 15 nM | >5% |
| | HTRF- Human TIGIT/CD155 neutralisation | Human TIGIT-Fc (Seq ID No: 545) Human CD155-His (Seq ID No: 575) | 0.25 nM 1 nM | <70% |

Clones showing the ability to bind to human and cyno TIGIT if also able to neutralise the interaction of target with human CD155 were selected for secondary screen. Potential mouse cross-reactive or mouse only binders were taken forward for further characterisation regardless of their neutralisation profile. A summary of primary hits identified following each screening campaign is captured in Table 26.

TABLE 26

Primary screening campaigns

| Screening campaign | Binding to human TIGIT (HTRF/Envision) | Binding to mouse TIGIT (HTRF) | Binding to cyno TIGIT (HTRF) | TIGIT:CD155 neutralisation (HTRF) | Primary hits |
|---|---|---|---|---|---|
| KM091-B1 | 80<br>336 (Envision) | 322 (ELISA) | Not tested | 144 | 125 |
| KM091-B2 | 86 | 1 | 37* | 58 | 56 |
| KM101-B1 | 103 | 0 | 95 | 103 | 65 |
| KM101-B2 | 152 | 1 | 127 | 95 | 59 |
| KM115-B1 | 48 | 5 | 38 | 34 | 10 |
| KM116-B1 | 56 | 14 | 64 | 51 | 32 |
| KM127-B1 | 56 | 97 | 92 | 27 | 97 |

*binding to cyno TIGIT was assessed at the secondary screening stage but included in this table for simplification purposes.

Materials and Methods a) Binding to Recombinant Human, Mouse and Cyno TIGIT by HTRF®

5 μL BCT supernatants were transferred to a white 384 well, low-volume, non-binding surface polystyrene plate (Greiner). In addition, 5 μL of 12 nM anti-human TIGIT (MAB7898), 12 or 40 nM cyno cross-reactive anti-human TIGIT (eBiosciences, catalogue number MBSA43) or 4 nM anti-mouse TIGIT (142102, Biolegend) were prepared in Expi293™ culture media and added to total binding wells. Non-specific binding wells included the appropriated isotype controls at assay concentrations used for reference molecules. Control curves were added on to a separate plate, using reference and isotype antibodies titrated from 120 nM in EXPI293™ culture media as per 3-fold dilution series for the generation of a 11-point binding curve. 5 μL of 647-labelled human, mouse or cyno TIGIT prepared in HTRF assay buffer (PBS (Sigma)+0.53 M KF (Sigma)+0.1% w/v BSA (Sigma)) at concentrations listed in Table 25 were added to whole plate. Finally, 10 μL of goat anti-mouse IgG (Southern Biotech) labelled with Europium cryptate (Cisbio) diluted at 1/1000 in HTRF assay buffer was added to assay plates, which were then incubated protected from light for 3 hours at room temperature. Plates were read using an EnVision plate reader (Perkin Elmer) for measurement of wells at 620 nm and 665 nm emission wavelengths. More details of the HTRF® assay technology can be found in Mathis (1995) Clinical Chemistry 41(9), 1391-1397.

Data were analysed by calculating 665/620 ratio (Equation 13) and percentage of effect (Equation 14) for each sample.

Calculation of 665/620 ratio

665/620 ratio = (sample 665/620 nm value)  Equation 13

Calculation of percentaage of effect
Using 665/620 nm ratio (see equation 13)

$$\text{Percentage of effect} = \frac{(\text{sample well} - \text{non-specific binding})}{\text{Total binding} - \text{non-specific binding}} \times 100 \quad \text{Equation 14}$$

Non-specific binding = values from wells containing isotype control antibody
Total Binding = values from wells containing reference antibody b) Binding to Human TIGIT CHO Cells 80 μL of CHO-S cells expressing human TIGIT (Seq ID No: 543) were re-suspended in F12 media (Gibco) supplemented with 10% Foetal Bovine Serum (Gibco) and dispensed at a density of 4×10⁴ cells per well in black walled 384 well, clear bottom Poly-D-Lysine plates (Greiner). Plates were incubated overnight at 37° C. 5% C02 to allow for cells to bind to plates. The next day media was aspirated before adding 40 μL of BCT supernatant, reference and isotype control antibodies. Anti-human TIGIT antibody (R&D, Catalogue number MAB7898) and relevant isotype controls were prepared at 10 nM final assay concentration in Expi293™ media (Gibco) and added to total and non-specific binding wells or titrated using a three-fold dilutions series from 30 nM final assay concentration in Expi293™ media. Before addition of secondary detection and cell dye, plates were incubated for 1 hour at 4° C. to allow antibody binding to target. After incubation, media was aspirated to remove unbound antibodies. Secondary antibody (Alexa Fluor® 647 Goat anti-mouse IgG Fcγ Fragment Specific (JacksonImmunoResearch) and Vybrant® DyeCycle™

Green stain (ThermoFischer) were added at 3 µg/mL and 1/500 dilution respectively in buffer ((PBS (sigma)+1% BSA (Sigma)+0.1% Sodium Azide (SevernBiotech)). Plates were then incubated at 4° C. for a further hour, before aspiration of unbound secondary antibody and fixation of cells for 20 minutes with 4% paraformaldehyde (Affymetrix). To remove fixative plates were washed once with PBS (Sigma) and blotted to remove excess liquid before measurement at 665 nM and 485 nM emission wavelengths using an EnVision plate reader (Perkin Elmer). Data were analysed by calculating 665/485 ratio (Equation 15) and percentage of effect (Equation 16) for each sample.

Calculation of 665/485 ratio $$665/485 \text{ ratio} = (\text{sample } 665/485 \text{ nm value}) \quad \text{Equation 15}$$

Calculation of percentage of effect
Using 665/485 nm ratio (see equation 15)

$$\text{Percentage of effect} = \frac{\text{sample value} - \text{non-specific binding}}{\text{total binding} - \text{non-specific binding}} \times 100 \quad \text{Equation 16}$$

Non-specific binding = values from wells containing isotype control antibody
Total Binding = values from wells containing reference antibody c) Binding to Mouse TIGIT by DELFIA® Time-Resolved Fluorescence Mouse TIGIT (Seq ID No: 560), prepared at 0.5 µg/mL in PBS, was added to high protein binding 96-well plates (Costar) (50 µL/well) and incubated overnight at 4° C. Excess IgG was removed by washing three times with PBS Tween (0.1% v/v) before wells were blocked with 1% w/v bovine serum albumin (BSA, Sigma) in PBS for 1 hour at room temperature. Following this blocking step, plates were washed again three times with PBS-Tween (0.1% v/v) before the addition of 50 µL/well of BCT supernatants to plates. Reference anti-mouse TIGIT (Biolegend, Catalogue number 142102) and isotype control antibody were prepared in dilution buffer (0.1% w/v BSA in PBS) at 10 nM final assay concentration in Expi293™ media (Gibco) and added to total and non-specific binding control wells. Binding curve was prepared using reference and isotype control antibodies titrated 1:3 from 30 nM final assay concentration in Expi293™ media. Following 1 hour incubation at room temperature, plates were washed as detailed previously. 50 µL/well of DELFIA® Eu-N1 Rabbit Anti-Mouse IgG (Perkin Elmer) diluted 1/1000 in DELFIA® assay buffer (Perkin Elmer) was added to plates and incubated for 1 hour at room temperature. Unbound DELFIA® Eu-N1 Rabbit Anti-Mouse IgG was removed by washing with DELFIA wash buffer (0.5 M Tris HCL, 1% tween v/v) before the addition of 50 µL DELFIA® Enhancement Solution (Perkin Elmer). Plates were protected from light and incubated for 5 minutes at room temperature, before being read at 615 nm using appropriate settings for DELFIA® Time resolved fluorescence on an Envision plate reader (Perkin Elmer). Assay values of total binding and non-specific wells were used to calculate z' prime and assay window. Clones were considered cell binders if raw data counts were above cut off calculated as defined by Equation 17.

Cut off Average non-specific binding+3*standard deviation non-specific binding Non-specific binding=values from wells containing isotype control antibody  Equation 17: Calculation of cut off d) TIGIT/CD155 Receptor-Ligand HTRF® Assay 5 µL BCT supernatants were transferred to a white 384 well, low-volume, non-binding surface polystyrene plate (Greiner) and mixed with 5 µL of human TIGIT-Fc prepared in HTRF assay buffer (PBS (Sigma)+0.53 M KF (Sigma)+ 0.1% w/v BSA (Sigma)). Control curves were added on separate plates using anti-human TIGIT (MAB7898) and isotype control antibodies prepared at 120 nM working concentration in EXPI293™ culture media and titrated as per 1:3 dilution curve for a curve composed of 11 concentration points. Plates were incubated for 1 hour at room temperature to allow antibody-receptor interaction to occur. Following this incubation time, 5 µL of 647-CD155-His diluted in HTRF buffer assay buffer were added to plates except non-specific binding wells, which included 5 µL of HTRF buffer. 5 µL of a solution composed of anti-human Fc cryptate (Cisbio) at 1/100 in HTRF assay buffer was added to all wells. Plates were incubated for 3 hours at room temperature and protected from light before measurement of wells at 620 nm and 665 nm emission wavelengths using an EnVision plate reader (Perkin Elmer). Data were analysed by calculating 665/620 ratio (Equation 13) and percentage of CD155 specific binding (Equation 18) for each sample. Total binding was defined by assay signal of wells with TIGIT-Fc and 647-CD155-His, while non-specific binding was established by measuring assay signal of wells with TIGIT-Fc only.

Percentage of $CD155$ specific binding

Using 665/620 nm ratio (see equation 13) ($HTRF$)

$$\text{Percentage of } CD155 \text{ specific binding} = \frac{\text{sample value} - \text{non-specific binding}}{\text{total binding} - \text{non-specific binding}} \times 100 \quad \text{Equation 18}$$

Total binding = 647-$CD$155-$His$ + $TIGIT$-$Fc$ + $EXPI$293™ culture media + anti-human $Fc$ cryptate
Non-specific binding = $TIGIT$-$Fc$ + $EXPI$293™ culture media + anti-human $Fc$ cryptate Example 36: TIGIT: BCT Secondary Screening Binding of primary hits to target in a cellular context was investigated using human (Seq ID No: 543) and mouse TIGIT (Seq ID No: 558) transfected CHO-S cells by flow cytometry, while SPR was used to determine Kds to human (Seq ID No: 539), cyno (Seq ID No: 554) and mouse (Seq ID No: 560) recombinant proteins. Secondary hits are confirmed cell binders with an affinity to human TIGIT equal or below 10 nM and cyno TIGIT Kd within 10-fold. Process of selection is summarised in Table 27.

TABLE 27

Secondary screening campaigns

| Screening campaign | Binding to human TIGIT (FACS) | Binding to mouse TIGIT (FACS) | Binding to human TIGIT (SPR) | Secondary hits |
|---|---|---|---|---|
| KM091-B1 | 37 | 125 | 70 | 40 |
| KM091-B2 | 53 | 0 | 56 | 10 |
| KM101-B1 | 56 | 0 | 52 | 25 |
| KM101-B2 | 59 | Not tested | 51 | 38 |
| KM115-B1 | 1 | Not tested | 2 | 5 (mouse binders) |
| KM116-B1 | 21 | 0 | 19 | 32 |
| KM127-B1 | 0 | 0 | 0 to human TIGIT 30 to mouse TIGIT | 60 |

Methods a) Binding to Human and Mouse TIGIT CHO Cells by Flow Cytometry

50 µL of untransfected, human (Seq ID No: 543) or mouse TIGIT (Seq ID No: 558) CHO cells prepared at 4×10$^6$ cells/mL were added to 96-well, v-bottom plates (Greiner) and pelleted following three washing steps in FACS buffer (PBS+1% w/v BSA+0.1% w/v sodium azide). 25 µL/well of BCT supernatants were incubated with cells for one hour at 4° C., as well as positive and negative controls for binding. Total binding was defined by 0.5-1 µg/mL anti-human TIGIT (R&D, Catalogues number MAB7898), 0.5-1 µg/mL anti-mouse TIGIT (Biolegend, Catalogue number 142102) or 3 µg/mL anti-mouse TIGIT (Thermo Fisher Scientific, Catalogue number 12-9501-82) and appropriate isotype controls in EXPI293™ media. Reference antibodies and isotype control antibodies were prepared at 10 µg/mL working concentration in EXPI293™ culture media and titrated as per 1:3 dilution curve for control curve of 11 concentration points. Cells were washed as described previously before adding 50 µL/well Alexa Fluor 647 AffiniPure Goat anti-Mouse IgG Fcγ Fragment Specific (Jackson ImmunoResearch) or Alexa Fluor 647 AffiniPure Goat Anti-Rat IgG (H+L) (Jackson ImmunoResearch), diluted 1:500 in FACS buffer. Following a 30-minute incubation at 4° C. in the dark, cells were washed, pelleted and re-suspended in 4% paraformaldehyde (Affymetrix) for 20 minutes. Final washing step removed fixing solution before cells were re-suspended in 100 µL FACS buffer. Flow cytometry was performed using BD FACS Array instrument and Kaluza®/FlowJo® to quantify 647 geometric mean of each tested sample. Clones were confirmed as cell binders if presenting a geometric mean value above three times standard deviation of isotype control in transfected cells. Specific binding was confirmed if no binding was detected to untransfected cells using the same cut-off criteria as used for the TIGIT transfected cells.

b) Determination of Affinity by Surface Plasmon Resonance (SPR)

Affinity of secreted antibodies was assessed by testing BCT supernatants by Label-free surface plasmon resonance (SPR). This analysis was carried out on the ProteOn XPR36 (BioRad) array SPR machine. An anti-mouse IgG capture surface was created on a GLM biosensor chip using amine coupling of an anti-mouse IgG from GE Healthcare. Test antibodies were captured on this surface and human (Seq ID No: 539), mouse (Seq ID No: 560) and cyno TIGIT (Seq ID No: 554) were used as analyte. The assay was carried out at 25° C. using HBS-EP (Teknova H8022). Buffer alone was used to reference the binding sensograms. The data was analysed using the 1:1 model inherent to the ProteOn XPR36 analysis software.

Example 37: TIGIT: Identification of Lead Panel (1)

Antibodies were reformatted with a human IgG4 constant region and expressed in HEK 293 or CHO cells and purified using standard methods. Sequencing was performed by Source Bioscience and results were added to sequence listing table (Seq ID No: 597-Seq ID No: 752). V gene usage is listed in Table 28.

TABLE 28

V Gene usage for Lead panel (1)

| | Heavy Chain | | | | | Light Chain | | | |
|---|---|---|---|---|---|---|---|---|---|
| Antibody CLONE ID | V gene | D gene | J gene | CDR3 length (aa) | CDR3 mutations from germline (aa) | V gene | J gene | CDR3 length (aa) | CDR3 mutations from germline (aa) |
| KY01 | IGHV3-9*01 | IGHD6-19*01 | IGHJ6*02 | 14 | 3 | IGKV2-28*01 | IGKJ4*01 | 9 | 1 |
| KY02 | IGHV3-11*01 | IGHD3-10*01 | IGHJ4*02 | 14 | 6 | IGKV1D-39*01 | IGKJ2*04 | 9 | 1 |
| KY03 | IGHV3-15*01 | IGHD3-9*01 | IGHJ4*02 | 12 | 5 | IGLV3-1*01 | IGLJ2*01 | 9 | 0 |
| KY04 | IGHV4-4*02 | IGHD3-9*01 | IGHJ6*02 | 19 | 5 | IGLV3-10*01 | IGLJ3*02 | 11 | 3 |
| KY05 | IGHV3-9*01 | IGHD6-19*01 | IGHJ4*02 | 16 | 6 | IGKV2-28*01 | IGKJ2*04 | 9 | 0 |
| KY06 | IGHV3-9*01 | IGHD6-19*01 | IGHJ4*02 | 16 | 7 | IGKV2-28*01 | IGKJ2*04 | 9 | 0 |
| KY07 | IGHV3-9*01 | IGHD6-19*01 | IGHJ4*02 | 16 | 6 | IGKV2-28*01 | IGKJ2*04 | 9 | 0 |
| KY08 | IGHV3-9*01 | IGHD6-19*01 | IGHJ4*02 | 16 | 6 | IGKV2-28*01 | IGKJ2*04 | 9 | 0 |
| KY09 | IGHV3-15*01 | IGHD3-9*01 | IGHJ5*02 | 12 | 4 | IGLV3-1*01 | IGLJ2*01 | 9 | 0 |
| KY10 | IGHV3-15*01 | IGHD3-9*01 | IGHJ5*02 | 12 | 5 | IGLV3-1*01 | IGLJ2*01 | 9 | 0 |
| KY11 | IGHV3-15*01 | IGHD3-9*01 | IGHJ5*02 | 12 | 4 | IGLV3-1*01 | IGLJ2*01 | 9 | 0 |
| KY12 | IGHV3-15*01 | IGHD3-9*01 | IGHJ5*02 | 12 | 4 | IGLV3-1*01 | IGLJ2*01 | 9 | 0 |
| KY13 | IGHV3-11*01 | IGHD3-10*01 | IGHJ4*02 | 14 | 6 | IGKV1D-39*01 | IGKJ2*04 | 9 | 1 |
| KY14 | IGHV3-15*01 | IGHD3-9*01 | IGHJ5*02 | 13 | 6 | IGLV3-1*01 | IGLJ1*01 | 9 | 1 |

TABLE 28-continued

V Gene usage for Lead panel (1)

| | Heavy Chain | | | | | Light Chain | | | |
|---|---|---|---|---|---|---|---|---|---|
| Antibody CLONE ID | V gene | D gene | J gene | CDR3 length (aa) | CDR3 mutations from germline (aa) | V gene | J gene | CDR3 length (aa) | CDR3 mutations from germline (aa) |
| KY15 | IGHV3-15*01 | IGHD3-9*01 | IGHJ5*02 | 13 | 5 | IGLV3-1*01 | IGLJ1*01 | 9 | 0 |
| KY16 | IGHV3-9*01 | IGHD1-14*01 | IGHJ6*02 | 14 | 4 | IGKV2-28*01 | IGKJ4*1 | 9 | 0 |
| KY17 | IGHV3-9*01 | IGHD2-21*02 | IGHJ6*02 | 14 | 5 | IGKV2-28*01 | IGKJ2*04 | 9 | 1 |
| KY18 | IGHV3-9*01 | IGHD2-21*02 | IGHJ6*02 | 14 | 7 | IGKV2-28*01 | IGKJ2*04 | 9 | 0 |
| KY19 | IGHV3-9*01 | IGHD4-17*01 | IGHJ6*02 | 14 | 6 | IGKV2-28*01 | IGKJ4*1 | 9 | 0 |
| KY20 | IGHV3-9*01 | IGHD6-19*01 | IGHJ6*02 | 14 | 3 | IGKV2-28*01 | IGKJ4*1 | 9 | 0 |
| KY21 | IGHV3-11*01 | IGHD3-10*01 | IGHJ6*02 | 14 | 4 | IGKV1-5*03 | IGKJ4*1 | 7 | 0 |
| KY22 | IGHV3-20*d01 | IGHD6-13*01 | IGHJ4*02 | 13 | 4 | IGKV1D-39*01 | IGKJ4*1 | 9 | 1 |
| KY23 | IGHV3-9*01 | IGHD4-23*01 | IGHJ6*02 | 14 | 8 | IGKV2-28*01 | IGKJ4*1 | 9 | 0 |

The following example describes assays performed to further characterise binding and neutralisation profile of secondary hits, captured in Table 29. Clones were tested in the TIGIT/CD155 HTRF® receptor-ligand assays and analysed by flow cytometry to characterise both binding and neutralisation profile. Confirmation of binding to human and cyno was also performed by HTRF® for KM091-B2 lead clones (data not shown). All mouse binders identified following screening campaigns were re-tested by HTRF®. Finally, SPR was performed for measurement of Kds to human, mouse and cyno TIGIT. These data allowed the selection of a lead panel composed of 23 clones identified from KM091-B2, KM101-B1 or KM101-B2 immunisation campaigns.

TABLE 29

Hits selected following confirmation assays

| Screening campaign | Clones recovered/ expressed | TIGIT/ CD155 Neutralisation (HTRF) | Binding to mouse TIGIT (HTRF/ FACS) | Binding and Neutralisation (Flow cytometry) | Binding to human TIGIT (SPR) | Clones selected |
|---|---|---|---|---|---|---|
| KM091-B1 | 34/25 | Not tested | Not tested | Not tested | 15/25 | 0 |
| KM091-B2 | 10/9 | 9 | 0 | 9 (7 neutralisers) (2 increased CD155 binding) | 9/9 | 9 |
| KM101-B1 | 25/25 | 21 | Not tested | 19 | 19 | 13 |
| KM101-B2 | 37/37 | 37 | 0 | 8 (neutralisers) 5 (increase CD155 binding) | 36 | 9 |
| KM115-B1 | 5/5 | 1 | 5 (HTRF) 0 (FACS) | 0 | 4 (mouse binders) | 0 |
| KM116-B1 | 23 | 10 | Not tested | 10 | 15 | 0 |
| KM127-B1 | 28/28 | Not run | 26 (HTRF) 0 (FACS) | Not tested | Not tested | 0 |

Clones included in the lead panel are characterised (with one exception) by Kds to human TIGIT below 3 nM, which is the reported affinity for TIGIT/CD155 interaction. In addition, molecules show an equivalent potency to anti-TIGIT benchmark antibody in the HTRF® ligand-receptor assay. Ability of clones to block CD155/TIGIT interaction was also confirmed by flow cytometry which resulted in the identification of neutraliser antibodies but also a sub-group of molecules showing the apparent ability to increase CD155 binding to cells. Summary of binding, neutralisation and affinity profile of the 23 human anti-TIGIT leads is captured in Table 30.

TABLE 30

Lead panel characterisation (1)

| Clone number | Screening campaign | Human KD (nM) | Cyno KD (nM) | Neutralisation IC50 nM (HTRF) | Neutralisation IC50 nM (Cells) |
|---|---|---|---|---|---|
| KY22 | KM091-B2 | 0.26 | 0.66 | IC minimum CD155 binding 42.92% | Increased CD155 binding |

TABLE 30-continued

Lead panel characterisation (1)

| Clone number | Screening campaign | Human KD (nM) | Cyno KD (nM) | Neutralisation IC50 nM (HTRF) | Neutralisation IC50 nM (Cells) |
|---|---|---|---|---|---|
| KY23 | KM091-B2 | 2.46 | 14.1 | 4.465 | 0.12 |
| KY21 | KM091-B2 | 0.4 | 4.24 | IC minimum CD155 binding 15.71% | Increased CD155 binding |
| KY20 | KM101-B1 | 3.34 | 12.7 | 1.41 | 0.21 |
| KY01 | KM101-B1 | 1.71 | 8.78 | 1.961 | IC |
| KY18 | KM101-B1 | 3.99 | 14.2 | 1.888 | 0.31 |
| KY02 | KM101-B1 | 0.17 | 5.38 | 4.427 | 0.09 |
| KY17 | KM101-B1 | 7.11 | 30.6 | 2.085 | 0.31 |
| KY13 | KM101-B1 | 0.18 | 5.9 | 4.228 | 0.13 |
| KY19 | KM101-B1 | 2.27 | 8.71 | 1.935 | 0.093 |
| KY16 | KM101-B1 | 2.22 | 8.4 | 4.941 | 0.43 |
| KY14 | KM101-B1 | 1.38 | 6.75 | 4.528 | 0.19 |
| KY03 | KM101-B1 | 1.71 | 4.36 | 2.402 | 0.29 |
| KY15 | KM101-B1 | 1.58 | 9.53 | 1.824 | 0.28 |
| KY04 | KM101-B1 | 0.59 | 2.42 | 2.907 | 0.19 |
| KY09 | KM101-B2 | 2.35 | 17.7 | 2.222 | 0.86 |
| KY10 | KM101-B2 | 0.57 | 2.64 | 4.289 | 0.56 |
| KY11 | KM101-B2 | 1.89 | 12.1 | 2.271 | 0.84 |
| KY12 | KM101-B2 | 0.86 | 6.95 | 3.026 | 0.99 |
| KY05 | KM101-B2 | 0.49 | 0.23 | IC minimum CD155 binding 16.85 | Increased CD155 binding |
| KY06 | KM101-B2 | 0.6 | 0.39 | IC minimum CD155 binding 19.71 | Increased CD155 binding |
| KY07 | KM101-B2 | 0.83 | 0.33 | IC minimum CD155 binding 16.42 | Increased CD155 binding |
| KY08 | KM101-B2 | 0.81 | 0.43 | IC minimum CD155 binding 14.77 | Increased CD155 binding |

Methods a) Binding to Human, Mouse and Cyno TIGIT by HTRF®

Lead anti-TIGIT antibodies, benchmark molecules and isotype antibodies were titrated from 120 nM in HTRF buffer as per 3-fold dilution series for the generation of a 11-point binding curve. These were transferred to a white 384-well, low volume, non-binding surface polystyrene plate (Greiner). In addition, 5 µL of 1 nM or 3 nM anti-TIGIT benchmarks and appropriate isotype antibodies were added to total and non-specific binding wells. 5 µL of 60 nM 647-human (Seq ID No: 539), 20 nM 647-mouse (Seq ID No: 560) or 60 nM 647-cyno TIGIT (Seq ID No: 554) prepared in HTRF assay buffer (PBS (Sigma)+0.53 M KF (Sigma)+0.1% w/v BSA (Sigma)) were added to all wells and incubated for 1 hour at room temperature protected from light. Finally, 10 µL of anti-human Fc cryptate (Cisbio) at 1/100 in HTRF assay buffer was added to whole plates, which were then incubated and protected from light for 3 hours at room temperature. Plates were read using an EnVision plate reader (Perkin Elmer) for measurement of wells at 620 nm and 665 nm emission wavelengths. Data were analysed by calculating 665/620 ratio (Equation 13) and percentage Delta F (Equation 19) for each sample. Non-specific binding was defined using isotype control wells.

Calculation of Delta $F$

Using 665/485 nm ratio (see equation 15)

$$\text{Percentage Delta } F = \frac{\text{sample value} - \text{non-specific binding}}{\text{non-specific binding}} \times 100 \quad \text{Equation 19}$$

b) TIGIT/CD155 Receptor-Ligand HTRF® Assay

Anti-TIGIT antibodies, benchmark molecules and isotype control were prepared from 120 nM working concentration in HTRF assay buffer (PBS (Sigma)+0.53 M KF (Sigma)+0.1% w/v BSA (Sigma)) and diluted 1:3, 11 points. On occasions a higher starting concentration of 360-400 nM was used. 5 µL of each titration was transferred to a white 384 well, low-volume, non-binding surface polystyrene plates (Greiner) and mixed with 5 µL of 647-TIGIT (Seq ID No: 539) at 60 nM and 5 µL of Biotin-CD155 at 25 nM (Seq ID No: 575). Following the addition of ligand and receptor solutions, 5 µL of a solution composed of streptavidin K (Cisbio) at 1/100 in HTRF assay buffer was added to whole plate and incubated for 3 hours protected from the light. After incubation, plates were read at 620 nm and 665 nm emission wavelengths using an EnVision plate reader (Perkin Elmer). Total binding wells included biotinylated CD155 and 647-TIGIT, whereas CD155 or 647-TIGIT only was added to negative control wells for measurement of non-specific binding. A CD155 titration curve was also run in parallel with testing of anti-TIGIT antibodies, prepared from 100 nM as per 1:2 dilution curve for 11 concentration points. For each assay, the ligand-receptor EC50 was calculated. Data were analysed by calculating 665/620 ratio (Equation 13) and percentage of CD155 specific binding (Equation 18) for each sample. Data was plotted using a 4-parameter logistic fit enabling determination of $IC_{50}$ values (Equation 20).

$Y=\text{Bottom}+(\text{Top}-\text{Bottom})/(1+10^{\wedge}((\text{Log IC50}-X)*\text{HillSlope}))$   Equation 20: Four Parameter locistic calculation $X$=logarithm of concentration.
$Y$=Percentage of CD155 specific binding (equation 18)
Top and Bottom=Plateaus in same units as Y (specific binding)

Log $IC_{50}$ in same units as X. Y starts at Bottom and goes to Top with a sigmoid shape. Percentage of CD155 specific binding decreases as X increases.

c) Binding and TIGIT/CD155 Ligand-Receptor Assays by Flow Cytometry

Untransfected or human TIGIT HEK 293 cells (Seq ID No: 543) prepared at $2 \times 10^6$ viable cells/mL in FACS buffer (PBS+1% w/v BSA+0.1% w/v sodium azide) were pre-incubated for 20 minutes with Human Trustain FcX™ (BioLegend) before adding 50 µL to 96-well, v-bottom plates (Greiner). Cells were pelleted following three washing steps and mixed with 25 µL anti-TIGIT antibodies, benchmarks and isotype controls titrated from 300 or 100 nM final assay concentration in FACS buffer using a three-fold series for the generation of a curve composed of 8 or 10 concentration points. Titration curves were transferred to assay plates, as well as positive and negative controls for binding, consisting of benchmark antibodies and relevant isotype controls which concentration was adjusted to 50 nM. Following this transfer, 25 µL of 647-CD155 (Seq ID No: 573) solution prepared at 250 or 80 nM working concentration were added to all wells expect non-specific binding wells used for calculation of percentage of CD155 specific binding. In addition, 25 µL 647-CD155 titrated from 1 µM using a two-fold serial dilution mixed with 25 µL of FACS assay buffer was added to cells to generate a ligand binding curve.

Cells were incubated with antibodies and CD155 for one hour at 4° C. before being washed as described previously and mixed with 50 µL PE goat-anti-mouse IgG (Jackson ImmunoResearch) diluted 1:500 in FACS buffer. Following a 30-minute incubation at 4° C. in the dark, cells were washed, pelleted and re-suspended in 4% paraformaldehyde (Affymetrix) for 20 minutes. Final washing step removed fixing solution before re-suspension of cells in 100 µL FACS buffer. Flow cytometry was performed using BD FACS Array instrument and FlowJo® to quantify PE/647 geometric mean of each tested sample. Data was analysed by calculating the percentage of CD155 specific binding. Data was plotted using a 4-parameter logistic fit enabling determination of IC50 values (Equation 20) and $EC_{50}$ values for binding (equation 21).

$Y=\text{Bottom}+(\text{Top}-\text{Bottom})/(1+10^{\wedge}((\text{Log EC50}-X)$
 \*HillSlope))   Equation 21: Four Parameter locistic calculation X=logarithm of concentration.
Y=Geometric mean
Top and Bottom=Plateaus in same units as Y (Geometric mean)
Log $EC_{50}$ in same units as X. Y starts at Bottom and goes to Top with a sigmoid shape. Geometric mean increases as X increases.

e) Binding to Endogenous TIGIT Expressing Cells

HH (ATCC® CRL-2105™) and CHO untransfected cells used as negative control for binding were re-suspended at $4 \times 10^6$ cells/ml in FACS buffer (PBS+1% w/v BSA+0.1% w/v sodium azide) and pre-incubated for 20 minutes with Human Trustain FcX™ (BioLegend) to prevent Fc binding of antibodies to cells. 25 µL of cells were added to 96-well, v-bottom plates (Greiner) and mixed with 25 µL/well of anti-TIGIT antibodies, benchmarks and isotype controls at single point concentration of 2 µg/mL in FACS buffer for one hour at 4° C. Wells including unstained cells and cells mixed with secondary antibody only, together with cells treated with isotype control, were used to define unspecific binding. Cells were washed by the addition of 150 µL FACS buffer and pelleted by centrifugation at 300g for 3 minutes. Process was repeated 3 times before adding 50 µL/well PE goat-anti-human IgG (Jackson ImmunoResearch) diluted 1:500 in FACS buffer to designated wells. Following 30-minute incubation at 4° C. in the dark, cells were washed as before, pelleted and re-suspended in 4% paraformaldehyde (Affymetrix) for 20 minutes. Final washing step removed fixing solution before re-suspending cells in 100 µL in FACS buffer. Flow cytometry was performed using CytoFlex and FlowJo® to quantify PE geometric mean of each tested sample. Histogram of each antibody was overlaid with histograms for unstained cells, secondary antibody control wells, reference and isotype control antibodies.

f) Determination of Affinity by Surface Plasmon Resonance (SPR)

Methodology run as described in Example 36, no deviations to protocol were introduced.

Example 38: TIGIT: Identification of Lead Panel (2)

Figure 38:
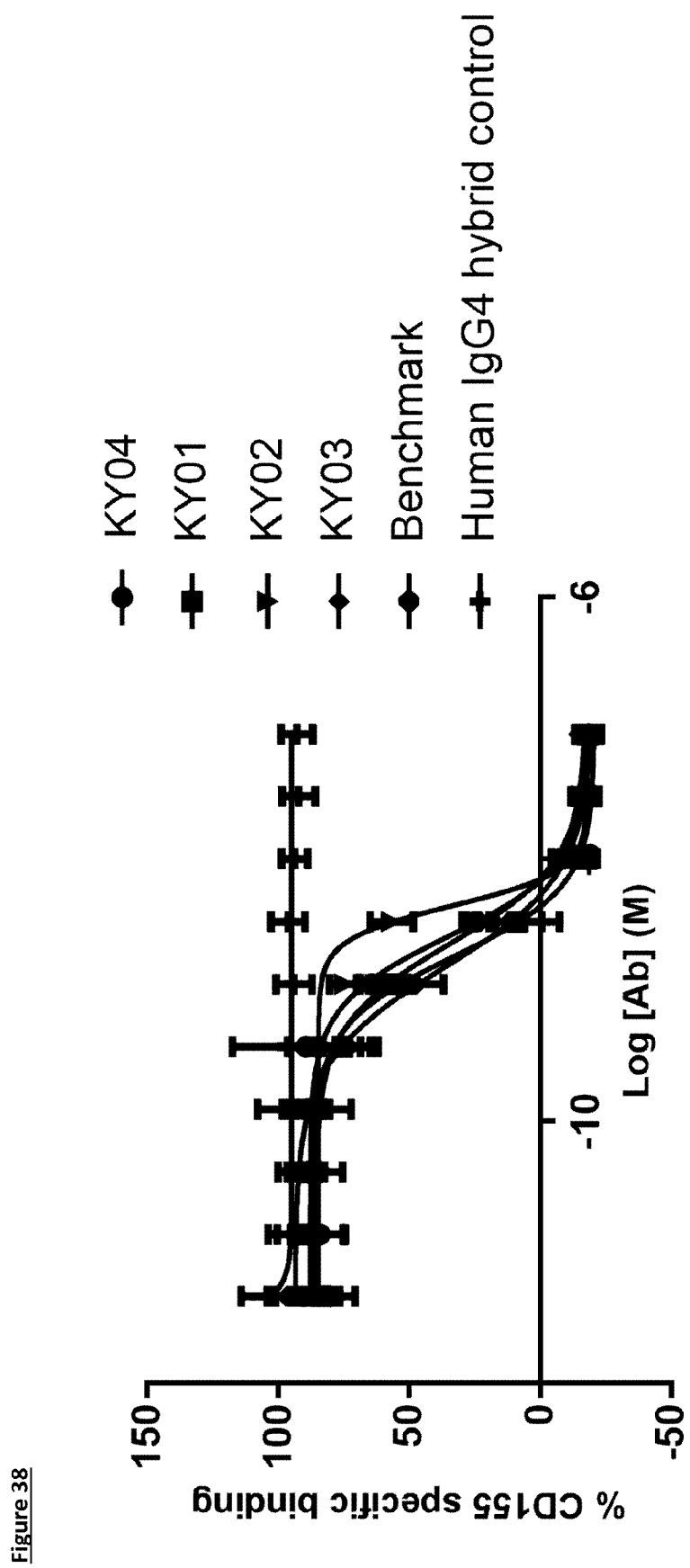
FIG. 38: Four lead molecules (KY01, KY02, KY03 and KY04) were tested in the TIGIT/CD155 receptor ligand HTRF® assay. Plot represents the mean and standard error of the percentage of CD155 specific binding versus antibody concentration (Log(M)) obtained in two independent experiments
Figure 39:
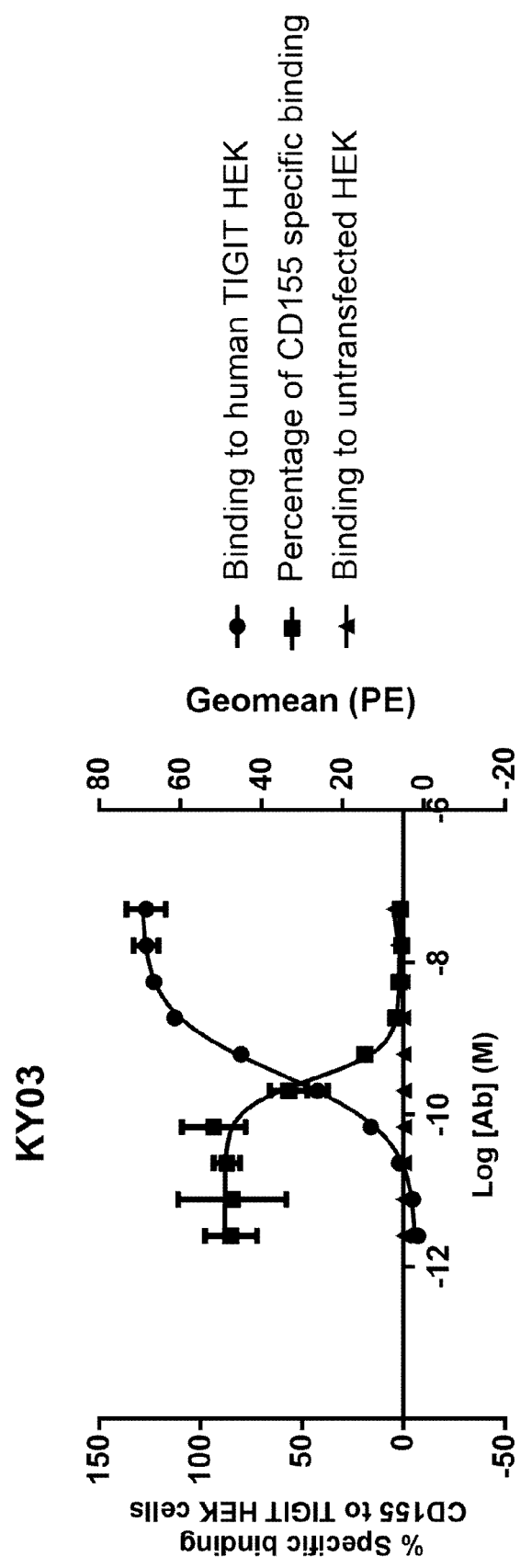
FIG. 39: Binding to human TIGIT and blocking of CD155/TIGIT interaction was investigated by flow cytometry using human TIGIT HEK 293 cells treated with recombinant CD155. Example data is shown for lead molecule KY02. Percentage of CD155 specific binding and PE geometric mean (geomean) referring to antibody binding were plotted on the left Y and right Y axis respectively versus antibody concentration (Log(M)).

This example describes the rational for lead selection of 4 top antibodies to be tested in primary functional assays such as an autologous monocyte—T cell assays, mixed lymphocyte reaction (MLR) or T cell killing assays described elsewhere in detail. Selected antibodies are listed in Table 31 and present 1) comparable potency to an anti-human benchmark antibody in the HTRF receptor-ligand assay (FIG. 38) 2) confirmed cell binders with the ability to block recombinant CD155 binding to TIGIT HEK 293 cells (FIG. 39); 3) affinity below reported affinity for TIGIT:CD155 interaction 4) sequence diversity represented by distinct V gene usage. Sequences have been added to sequence listing table: KY01 (Seq ID No: 597-616), KYO2 (Seq ID No: 617-636), KYO3 (Seq ID No: 637-656) and KYO4 (Seq ID No: 657-676).

INCORPORATION BY REFERENCE

All references cited herein, including patents, patent applications, papers, text books and the like, and the references cited therein, to the extent that they are not already, are hereby incorporated herein by reference in their entirety.

EQUIVALENTS

The foregoing written specification is considered to be sufficient to enable one skilled in the art to practice the invention. The foregoing description and Examples detail certain preferred embodiments of the invention. It will be appreciated, however, that the invention may be practiced in many ways and the invention should be construed in accordance with the appended claims and any equivalents thereof.

It will be understood that particular configurations, aspects, examples, clauses and embodiments described herein are shown by way of illustration and not as limitations of the invention. Any part of this disclosure may be read in combination with any other part of the disclosure, unless otherwise apparent from the context.

TABLE 31

| Lead panel (2) | | | | |
|---|---|---|---|---|
| Clone number | Human Kd (nM) | Cyno KD (nM) | TIGIT/CD155 receptor-ligand assay IC50 nM (HTRF) | TIGIT/CD155 receptor-ligand assay IC50 nM (Cells) |
| KY01 | 1.71 | 8.78 | 2 | IC |
| KY02 | 0.17 | 5.38 | 4.2 | 0.09 |
| KY03 | 1.71 | 4.4 | 2.4 | 0.29 |
| KY04 | 0.59 | 2.42 | 2.9 | 0.19 |

SEQUENCE LISTING

| SEQ ID NO: | Name | Description | Sequence |
|---|---|---|---|
| 1 | Human PD-L1 | NCBI number: NP_054862.1 (ECD highlighted in BOLD, cytoplasmic domain underlined) | MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQI TDVKLQDAGVYRCMISYGGADYKRITVKVNAPYNKINQRILVVDPVTSE HELTCQAEGYPKAEVIWTSSDHQVLSGKTTTTNSKREEKLFNVISTLRIN TTTNEIFYCTFRRLDPEENHTAELVIPELPLAHPPNERTHVILGAILLCLGVA LTFIFRLRKGRMMDVKKCGIQDTNSKKQSDTHLEET |
| 2 | Cyno PD-L1 | NCBI number: XP_014973154.1 (ECD highlighted in BOLD) | MGWSCIILFLVATATGVHSMFTVTVPKDLYVVEYGSNMTIECKFPVEKQLDL TSLIVYWEMEDKNIIQFVHGEEDLKVQHSNYRQRAQLLKDQLSLGNAAL RITDVKLQDAGVYRCMISYGGADYKRITVKVNAPYNKINQRILVVDPVT SEHELTCQAEGYPKAEVIWTSSDHQVLSGKTTTTNSKREEKLLNVTSTLR INTTANEIFYCIFRRLDPEENHTAELVIPELPLALPPNERT |
| 3 | Human PD-L1 His | Human PD-L1 ECD with C-terminal His tag | MRIFAVFIFMTYWHLLNAFTVTVPKDLYVVEYGSNMTIECKFPVEKQLDLAALIVYW EMEDKNIIQFVHGEEDLKVQHSSYRQRARLLKDQLSLGNAALQITDVKLQDAGVYR CMISYGGADYKRITVKVNAPYNKINQRILVVDPVTSEHELTCQAEGYPKAEVIWTSS DHQVLSGKTTTTNSKREEKLFNVTSTLRINTTTNEIFYCTFRRLDPEENHTAELVIPE LPLAHPPNERT<u>HHHHHH</u> |
| 4 | Human PD-L1 Fc | Human PD-L1 ECD with C-term Fc fusion (in bold) | MRIFAVFIFMTYWHLLNAFTVTVPKDLYVVEYGSNMTIECKFPVEKQLDLAALIVYW EMEDKNIIQFVHGEEDLKVQHSSYRQRARLLKDQLSLGNAALQITDVKLQDAGVYR CMISYGGADYKRITVKVNAPYNKINQRILVVDPVTSEHELTCQAEGYPKAEVIWTSS DHQVLSGKITTINSKREEKLFNVTSTLRINTTNEIFYCTFRRLDPEENHTAELVIPE LPLAHPPNERTIEGREPKSCDKTHTCPPCPAPELLGGPSVFLFPPKPKDTLM ISRTPEVTCVVVDVSHEDPEVKFNWYVDGVEVHNAKTKPREEQYNSTYR VVSVLTVLHQDWLNGKEYKCKVSNKALPAPIEKTISKAKGQPREPQVYT LPPSRDELTKNQVSLTCLVKGFYPSDIAVEWESNGQPENNYKTTPPVLD SDGSFFLYSKLTVDKSRWQQGNVFSCSVMHEALHNHYTQKSLSLSPGK |
| 5 | Cyno PD-L1 FLAG | Cynomolgus PD-L1 ECD with N-term FLAG tag | MGWSCIILFLVATATGVHSMFTVTVPKDLYVVEYGSNMTIECKFPVEKQLDLTSLIV YWEMEDKNIIQFVHGEEDLKVQHSNYRQRAQLLKDQLSLGNAALRITDVKLQDAG VYRCMISYGGADYKRITVKVNAPYNKINQRILVVDPVTSEHELTCQAEGYPKAEVI WTSSDHQVLSGKTTTTNSKREEKLLNVTSTLRINTTANEIFYCIFRRLDPEENHTAE LVIPELPLALPPNERT<u>DYKDDDDK</u> |
| 6 | Human PD-1 Fc | Human PD-1 full length sequence derived from cDNA as human Fc fusion | MGWSCIILFLVATATGVHSLDSPDRPWNPPTFSPALLVVTEGDNATFTCSFSNTSE SFVLNWYRMSPSNQTDKLAAFPEDRSQPGQDCRFRVTQLPNGRDFHMSVVRARR NDSGTYLCGAISLAPKAQIKESLRAELRVTERRAEVPTAHPSPSPRPAGQ<u>KLENLY FQGIEGRMDEPKSCDKTHTCPPCPAPELLGGPSVFLFPPKPKDTLMISRT PEVTCVVVDVSHEDPEVKFNWYVDGVEVHNAKTKPREEQYNSTYRVVS VLTVLHQDWLNGKEYKCKVSNKALPAPIEKTISKAKGQPREPQVYTLPP SRDELTKNQVSLTCLVKGFYPSDIAVEWESNGQPENNYKTTPPVLDSDG SFFLYSKLTVDKSRWQQGNVFSCSVMHEALHNHYTQKSLSLSP</u> |
| 7 | 84G09-CDRH1 (IMGT) | Amino acid sequence of CDRH1 of 84G09 using IMGT | GFTFDDYA |

SEQUENCE LISTING

| SEQ ID NO: | Name | Description | Sequence |
|---|---|---|---|
| 8 | 84G09-CDRH2 (IMGT) | Amino acid sequence of CDRH2 of 84G09 using IMGT | ISWKSNII |
| 9 | 84G09-CDRH3 (IMGT) | Amino acid sequence of CDRH3 of 84G09 using IMGT | ARDITGSGSYGMFDP |
| 10 | 84G09-CDRH1 (Kabat) | Amino acid sequence of CDRH1 of 84G09 using Kabat | DYAMH |
| 11 | 84G09-CDRH2 (Kabat) | Amino acid sequence of CDRH2 of 84G09 using Kabat | GISWKSNIIGYADSVKG |
| 12 | 84G09-CDRH3 (Kabat) | Amino acid sequence of CDRH3 of 84G09 using Kabat | DITGSGSYGMFDP |
| 13 | 84G09-Heavy chain variable region | Amino acid sequence of $V_H$ of 84G09 (mutations from germline are shown in bold letters) | EVQLVESGGGLVQPGRSLRLSCAASGFTFDDYAMHWVRQTPGKGLEWVSGISWK SNIIGYADSVKGRFTISRDNAKNSLYLQMNSLRAEDTALYYCARDITGSGSYGWFD PWGQGTLVTVSS |
| 14 | 84G09-Heavy chain variable region | Nucleic acid sequence of $V_H$ of 84G09 | CAAGAAAAAGCTTGCGCCACCATGAGTTTGGGCTGAGCTGGATTTCTTT GCTATTTTAAAAGGTGTCCAGTGTGAAGTACAATTGGTGAGTCCGGGGAG GCTTGTACAGCCTGGCAGGTCCCTGAGACTCTCTGTGCAGCCTCTGATTCA CCTTTGATGATTATGCCATGCACTGGGTCCGACAAACTCCAGGAGGGCCTGG AGTGGGTCTCAGGTATAAGTTGGAAGAGTAATATATCACGCGGACTCTG TGAAGGGCCGATTCACCATCTCCAGAGACAACGCCAAGAACTCCCTGTATCTGC AAATGAACAGTCTGAGAGCTGAGGACACGGCCTTGTATTATTGTGCAAGAGATA TAACGGGTTCGGGAGTTATGGCTGTTCGACCCCTGGGCCAGGGAACCCTG GTCACCGTCTCCTCAGCCAAAACGACACCCCCATCTGTCTATCCACTGGCCCCTG AATCTGCTAAAACTCAGCCTCCG |
| 15 | 84G09-full heavy chain sequence | Amino acid sequence of 84G09 heavy chain (mutations from germline are shown in bold letters) | EVQLVESGGGLVQPGRSLRLSCAASGFTFDDYAMHWVRQTPGKGLEWVSGISWK SNIIGYADSVKGRFTISRDNAKNSLYLQMNSLRAEDTALYYCARDITGSGSYGWFD PWGQGTLVTVSSASTKGPSVFPLAPCSRSTSESTAALGCLVKDYFPEPVTVSWNSG ALTSGVHTFPAVLQSSGLYSLSSVVTVPSSSLGTKTYTCNVDHKPSNTKVDKRVESK YGPPCPPCPAPEFEGGPSVFLFPPKPKDTLMISRTPEVTCVVVDVSQEDPEVQFNW YVDGVEHNAKTKPREEQFNSTYRVVSVLTVLHQDWLNGKEYKCKVSNKGLPSSIE KTISKAKGQPREPQVYTLPPSQEEMTKNQVSLTCLVKGFYPSDIAVEWESNGQPEN NYKTTPPVLDSDGSFFLYSRLTVDKSRWQEGNVFSCSVMHEALHNHYTQKSLSLSL GK |
| 16 | 84G09-full heavy chain sequence | Nucleic acid sequence of 84G09 heavy chain | GAAGTGCAGCTGGTGGAATCTGGCGGCGGACTGGTGCAGCCTGGCAGATCCCT GAGACTGTCTTGTGCCGCCTCCGGCTTCACCTTCGACGACTACGCTATGCACTG GGTGCGACAGACCCCTGGCAAGGGCCTGGAATGGGTGTCCGGCATCTCCTGGA AGTCCAACATCATCGGCTACGCCGACTCCGTGAAGGGCCGGTTCACCATCTCCC GGGACAACGCCAAGAACTCCCTGTACCTGCAGATGAACAGCCTGCGGGCCGAGG ACACCGCCCCTGTACTACTGCGCCAGAGACATCACCGGCTCCGGCTCCTACGGAT GGTTCGATCCTTGGGGCCAGGGAACCCTGGTCACCGTCTCCTCTGCCAGCACCA |

SEQUENCE LISTING

| SEQ ID NO: | Name | Description | Sequence |
|---|---|---|---|
| | | | AGGGCCCCTCTGTGTTCCCTCTGGCCCTTCCAGCAAGTCCACCTGTGGCGAA |
| | | | CAGCCGCTCTGGGCTGCCTCGTGACCAGGACTACTTCCCCGAGCCTGTGACCGTGT |
| | | | CCTGGAACTCTGGCGCTCTGACCAGCGGAGTGCACACCTTCCCTGCTGTGCTGC |
| | | | AGTCCTCCGGCCTGTACTCCCTGTCCTCCGTCGTGACCGTGCCTTCCAGTCTCT |
| | | | GGGCACCCAGACCTACATCTGCAACGTGAACCACAAGCCCTCCAACACCAAGGT |
| | | | GGACAAGAAGGTGGAACCTAAGTCCTGCGACAAGACCCACACCTGTCCCCTTG |
| | | | TCCTGCCCCTGAACTGCTGGGCGGACCTTCCGTGTTCCTGTTCCCCCCAAAGCC |
| | | | CAAGGACACCCTGATGATCTCCCGGACCCCCGAAGTGACTTGCGTGGTGGTGGA |
| | | | TGTGTCCCACGAGGACCCTGAAGTGAAGTTCAATTGGTACGTGGACGGCGTGGA |
| | | | AGTGCACAACGCCAAGACCAAGCCTAGAGAGGAACAGTACAACTCCACCTACCG |
| | | | GGTGGTGTCCGTGCTGACCGTGCTGCACCAGGATTGGCTGAACGGCAAAGAGT |
| | | | ACAAGTGCAAGGTGTCCAACAAGGCCCTGCCTGCCCCATCGAAAAGACCATCT |
| | | | CCAAGGCCAAGGGCCAGCCCCGGGAACCCCAGGTGTACACACTGCCCCCTAGCA |
| | | | GGGACGAGCTGACCAAGAACCAGGTGTCCCTGACCTGTCTGGTCAAAGGCTTCT |
| | | | ACCCCTCCGATATCGCCGTGGAATGGGAGTCCAACGGCCAGCCTGAGAACAACT |
| | | | ACAAGACCACCCCCCCTGTGCTGGACTCCGACGGCTCATTCTTCCTGTACAGCAA |
| | | | GCTGACAGTGGACAAGTCCCGGTGGCAGCAGGGCAACGTGTTCTCCTGCTCCGT |
| | | | GATGCACGAGGCCCTGCACAACCACTACACCCAGAAGTCCCTGTCCCTGAGCCC |
| | | | CGGCAAG |
| 17 | 84G09-CDRL1 (IMGT) | Amino acid sequence of CDRL1 of 84G09 using IMGT | QSISSY |
| 18 | 84G09-CDRL2 (IMGT) | Amino acid sequence of CDRL2 of 84G09 using IMGT | VAS |
| 19 | 84G09-CDRL3 (IMGT) | Amino acid sequence of CDRL3 of 84G09 using IMGT | QQSYSNPIT |
| 20 | 84G09-CDRL1 (Kabat) | Amino acid sequence of CDRL1 of 84G09 using Kabat | RASQSISSYLN |
| 21 | 84G09-CDRL2 (Kabat) | Amino acid sequence of CDRL2 of 84G09 using Kabat | VASSLQS |
| 22 | 84G09-CDRL3 (Kabat) | Amino acid sequence of CDRL3 of 84G09 using Kabat | QQSYSNPIT |
| 23 | 84G09-Light chain variable region | Amino acid sequence of V$_L$ of 84G09 | DIQMTQSPSSLSASVGDRVTITCRASQSISSYLNWYQQKPGKAPKLLIYVASSLQS GVPSSFSGSGSGTDFTLTISSLQPEDFATYYCQQSYSNPITFGQGTRLEIK |
| 24 | 84G09-Light chain variable region | Nucleic acid sequence of V$_L$ of 84G09 | GACATCCAGATGACCCAGTCTCCATCCTCCCTGTCTGCATCTGTAGGAGACAGA GTCACCATCACTTGCCGGGCAAGTCAGAGCATTAGCAGCTATTTAAATTGGTAT CAGCAGAAACCAGGGAAAGCCCCTAAGCTCCTGATCTATGTTGCATCCAGTTTG CAAAGTGGGGTCCCATCAAGTTTCAGTGGCAGTGGATCTGGGACAGATTTCACT CTCACCATCAGCAGTCTGCAACCTGAAGATTTTGCAACTTACTACTGTCAACAGA GTTACAGTAATCCGATCACCTTCGGCCAAGGGACACGACTGGAGATCAAA |

| SEQ ID NO: | Name | Description | Sequence |
|---|---|---|---|
| 25 | 84G09-full light chain sequence | Amino acid sequence of 84G09 light chain | DIQMTQSPSSLSASVGDRVTITCRASQSISSYLNWYQQKPGKAPKLIYVASSLQS GVPSSFSGSGSGTDFTLTISSLQPEDFATYCQQSYSNPITFGQGTRLEIKRTVAAP SVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 26 | 84G09-full light chain sequence | Nucleic acid sequence of 84G09 light chain | GACATCCAGATGACCCAGTCTCCATCCTCCCTGTCTGCATCTGTAGGAGACAGA GTCACCATCACTTGCCGGGCAAGTCAGAGCATTAGCAGCTATTTAAATTGGTAT CAGCAGAAACCAGGGAAAGCCCCTAAGCTCCTGATCTATGTTGCATCCAGTTTG CAAAGTGGGGTCCCATCAAGTTCAGTGGCAGTGGATCTGGGACAGATTTCACT CTCACCATCAGCAGTCTGCAACCTGAAGATTTTGCAACTTACTACTGTCAACAGA GTTACAGTAATCCGATCACCTTCGGCCAAGGGACAGACTGAGATCAAACGTA CGGTGGCCGCTCCCTCCGTGTTCATCTTCCCACCTTCCGACGAGCAGCTGAAGT CCGGCACCGCTTCTGTCGTGTGCCTGCTGAACAACTTCTACCCCCGCGAGGCA AAGTGCAGTGGAAGGTGGACAACGCCCTGCAGTCCGGCAACTCCCAGGAATCCG TGACCGAGCAGGACTCCAAGGACAGCACCTACTCCCTGTCCTCCACCCTGACCC TGTCCAAGGCCGACTACGAGAAGCACAAGGTGTACGCCTGCGAAGTGACCCACC AGGGCCTGTCTAGCCCCGTGACCAAGTCTTTCAACGGGCGAGTGT |
| 27 | 1D05-CDRH1 (IMGT) | Amino acid sequence of CDRH1 of 1D05 using IMGT | GFTFDDYA |
| 28 | 1D05-CDRH2 (IMGT) | Amino acid sequence of CDRH2 of 1D05 using IMGT | ISWIRTGI |
| 29 | 1D05-CDRH3 (IMGT) | Amino acid sequence of CDRH3 of 1D05 using IMGT | AKDMKGSGTYGGWFDT |
| 30 | 1D05-CDRH1 (Kabat) | Amino acid sequence of CDRH1 of 1D05 using Kabat | DYAMH |
| 31 | 1D05-CDRH2 (Kabat) | Amino acid sequence of CDRH2 of 1D05 using Kabat | GISWIRTGIGYADSVKG |
| 32 | 1D05-CDRH3 (Kabat) | Amino acid sequence of CDRH3 of 1D05 using Kabat | DMKGSGTYGGWFDT |
| 33 | 1D05-Heavy chain variable region | Amino acid sequence of $V_H$ of 1D05 (mutations from germline are shown in bold letters) | EVQLVESGGGLVQPGRSLRLSCAASGFTFDDYAMHWVRQVPGKGLEWVSGISWI RTGIGYADSVKGRFTIFRDNAKNSLYLQMNSLRAEDTALYYCAKDMKGSGTYGG WFDTWGQGTLVTVSS |
| 34 | 1D05-Heavy chain variable region | Nucleic acid sequence of $V_H$ of 1D05 | AAGCTTGCCGCCACCATGGAGTTTGGGCTGAGCTGGGTTTTCCTTTTGGCTATT TTAAAAGGTGTCCAGTGTGAAGTGCAGCTGGTGGAGTCTGGGGGAGGCTTGGT GCAGCCTGGCAGGTCCCTGAGACTCTCCTGTGCAGCCTCTGGATTCACCTTTGA TGATTATGCCATGCACTGGGTCCGGCAAGTTCCAGGGAAGGGCCTGAATGGG TCTCAGGCAATTAGTTGGATTCGTACTGGCATAGGCTATGCGGACTCTGTGAAGG GCCGATTCACCATTTTCAGAGACAACGCCAAGAATTCCCTGTATCTGCAAATGAA |

-continued

SEQUENCE LISTING

| SEQ ID NO: | Name | Description | Sequence |
|---|---|---|---|
| 35 | 1D05-full heavy chain sequence | Amino acid sequence of 1D05 heavy chain | EVQLVESGGGLVQPGRSLRLSCAASGFTFDDYAMHWVRQVPGKGLEWVSGISWI RTGIGYADSVKGRFTIFRDNAKNSLYLQMNSLRAEDTALYYCAKDMKGSGTYGGW FDTINGQGTLVTVSSASTKGPSVFPLAPCSRSTSESTAALGCLVKDYFPEPVTVSWN SGALTSGVHTFPAVLQSSGLYSLSSVVTVPSSSLGTKTYTCNVDHKPSNTKVDKRV ESKYGPPCPPCPAPEFEGGPSVFLFPPKPKDTLMISRTPEVTCVVVDVSQEDPEVQF NWYVDGVEVHNAKTKPREEQFNSTYRVVSVLTVLHQDWLNGKEYKCKVSNKGLP SSIEKTISKAKGQPREPQVYTLPPSQEEMTKNQVSLTCLVKGFYPSDIAVEWESNG QPENNYKTTPPVLDSDGSFFLYSRLTVDKSRWQEGNVFSCSVMHEALHNHYTQKS LSLSLGK |
| 36 | 1D05-full heavy chain sequence | Nucleic acid sequence of 1D05 heavy chain | GAAGTGCAGCTGGTGGAATCTGGCGGCGGACTGGTCCAGCCTGGCAGATCCT GAGACTGTCTTGTGCCGCTCCGGCTTCACCTTCGACGACTACGCTATGCACTG GGTGCGACAGGTGCCAGGCAAGGGCCTGGAATGGGTGTCCGGCATCTCTTGGA TCCGGACCGGCATCGGCTACGCCGACTCTGTGAAGGGCCGGTTCACCATCTTCC GGGACAACGCCAAGAACTCCCTGTACCTGCAGATGAACAGCCTGCGCGAGG ACACCGCCCTGTACTACTGCGCCAAGGACATGAAGGGCTCCGGCACCTACGGCG GATGGTTCGATACTATTGGGGCCAGGGCACCCTCGTGACCGTGTCCTCTGCCAGCA CCAAGGGCCCCTCTGTCTTCCCCCTGGCCCCCTGCTCCAGGAGCACCTCTGGCG GAACAGCGCCTCTGGCGTCCGTGACCAGCGAGTGCACCTACTTCCCGAGCCTGTGACCG TGTCCTGGAACTCTGGCGCTGTACTCCCTGTCCTCCGTGACCGTGACCTTCCAGCT CTCTGGGCTGTCCAGCGTCCCCCAGCTGAACGTGAATCCCAAAGCCCTCCAACACCAA GGTGGACAAGAAGGTGAACCAAGTCCTGCGACAAAGACCCACACACCGCTTGTCCCCCC TTGTCCTGCGCCCTGACCTGTGGGCGGACCTTCCGTGTTCCTGTTCCCCCCAAAA GCCCAAGGACACCCTGATGATCTCCCGGACCCCCGAAGTGACCTGCGTGGTGGT GGATGTGTCCCACGAGGACCCTGAAGTGAAGTTCAATTGGTACGTGGACGGCGT GGAAGTGCACAACGCCAAGACCAAGCCAAGAACCAGTACAACTCCACCTA CCGGGTGGTGTCCGTGCTGACCGTCCTGCACCAGGATTGGCTGAACGGCAAG AGTACAAGTGCAAGGTCCAAGTGTCCAACAAGGCCCTGCCTCCCCATCGAAAAGACCA TCTCCAAGGCCAAGGCCAGCCCGGAACCCAGGTGTACACACCGCTCCCCTA GCAGGACGAGCTGACCAAGAACCAGGTGTCCCTGACCTGTCTGTGAAGGCT TCTACCCCTCGATATCGCCTGGAATGGGAGTCCAACGGCCAGCCTGAGAACA ACTACAAGAACAGCCCCCCGTGCTGGACTCCGACGGCTCATTTCTTCCTGTACAG CAAGTCACAGTGGACAAGTCCCGGTGGCAGCAGGGCAACGTGTCTGTCCTC CGTGATGGACGAGGCCTGCACAACCACTACCCAGAAGTCCCTGTCCCTGAG CCCCGGCAAG |
| 37 | 1D05-CDRL1 (IMGT) | Amino acid sequence of CDRL1 of 1D05 using IMGT | QSISSY |
| 38 | 1D05-CDRL2 (IMGT) | Amino acid sequence of CDRL2 of 1D05 using IMGT | VAS |

-continued

SEQUENCE LISTING

| SEQ ID NO: | Name | Description | Sequence |
|---|---|---|---|
| 39 | 1D05-CDRL3 (IMGT) | Amino acid sequence of CDRL3 of 1D05 using IMGT | QQSYSTPIT |
| 40 | 1D05-CDRL1 (Kabat) | Amino acid sequence of CDRL1 of 1D05 using Kabat | RASQSISSYLN |
| 41 | 1D05-CDRL2 (Kabat) | Amino acid sequence of CDRL2 of 1D05 using Kabat | VASSLQS |
| 42 | 1D05-CDRL3 (Kabat) | Amino acid sequence of CDRL3 of 1D05 using Kabat | QQSYSTPIT |
| 43 | 1D05-Light chain variable region | Amino acid sequence of V<sub>L</sub> of 1D05 (mutations from germline are shown in bold letters) | DIQMTQSPSSLSASVGDRVTITCRASQSISSYLNWYQQKPGKAPKLLIYVASSLQS GVPSRFSGSGSGTDFTLTISSLQPEDFATYYCQQSYSTPITFGQGTRLEIK |
| 44 | 1D05-Light chain variable region | Nucleic acid sequence of V<sub>L</sub> of 1D05 | AAAGCTTGCCGCCACCATGAGGCTCCCTGCTCAGTTCTGGGGTCCTGCTACT CTGGCTCCGAGGTGCCAGATGACATCCAGATGACCCAGTCTCCATCCTCCCT GTCTGCATCTGTAGGAGACAGAGTCACCATCACTTGCCGGGCAAGTCAGAGCAT TAGCAGCTATTTAAATTGGTATCAGCAGAAACCAGGGAAAGCCCCTAAACTCCT GATCTATGTTGCATCCAGTTTGCAAAGTGGGGTCCCATCAAGGTTCAGTGGCAG TGGATCTGGGACAGATTTCACTCTCACCATCAGCAGTCTGCAACCTGAAGATTTT GCAACTTACTACTGTCAACAGAGTTACAGTACCCCGATCACCTTCGGCCAAGGG ACACGTCTGGAGATCAAACGTACGGATGCTGCACCAACT |
| 45 | 1D05-full light chain sequence | Amino acid sequence of 1D05 light chain | DIQMTQSPSSLSASVGDRVTITCRASQSISSYLNWYQQKPGKAPKLLIYVASSLQS GVPSRFSGSGSGTDFTLTISSLQPEDFATYYCQQSYSTPITFGQGTRLEIKRTVAAP SVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 46 | 1D05-full light chain sequence | Nucleic acid sequence of 1D05 light chain | GACATCCAGATGACCCAGTCTCCCCTCCCCAGCCTTCTGTCTTCCGTGGGCGACAGA GTGACCATCACCTGTCGGGCCTCCCAGTCAGTCATCTCCTCCTACCTGAACTGGTATC AGCAGAAGCCCGGCAAGGCCCCCAAGCTGCTGATCTACGTGGCCAGCTCTCTGC AGTCCGGCGTGCCCCTAGATTCTCCGGCTCGGCTCGGCACCGACTTTACCC TGACCATCAGCTCCCTGCAGCCCGAGGACTTCGCCACCTACTACTGCCAGAGT CCTACTCCACCCCTATCACCTTCGGCCAGGGCACCCGGCTGGAAATCAAACGTA CGGTGGCCGCTCCCGTCTTCATCTTCCCACCTTCCGACGAGCAGCTGAAGT CCGGCACCGCTTCTGTCGTGTGCCTGCTGAACAACTTCTACCCCCGAGGCCA AGGTGCAGTGGAAGGTGGACAACGCCCTGCAGTCCGGCAACTCCCAGGAATCCG TGACCGAGCAGGACTCCAAGGACTCCACCTACTCCCTGTCCTCCACCCTGACCC TGTCCAAGGCCGACTACGAGAAGCACAAGGTGTACGCCTGCGAAGTGACCCACC AGGGCCTGTCTAGCCCCGTGACCAAGTCTTTCAACCGGGGCGAGTGT |

-continued

SEQUENCE LISTING

| SEQ ID NO: | Name | Description | Sequence |
|---|---|---|---|
| 47 | Mutated 1D05-HC mutant 1 | Amino acid sequence of 1D05 heavy chain with V to A back-mutation in framework region to germline highlighted with IgG1 disabled (LAGA) constant region | EVQLVESGGGLVQPGRSLRLSCAASGFTFDDYAMHWVRQAPGKGLEWVSGISWI<br>RTGIGYADSVKGRFTIFRDNAKNSLYLQMNSLRAEDTALYYCAKDMKGSGTYGGW<br>FDTWGQGTLVTVSSASTKGPSVFPLAPCSRSTSESTAALGCLVKDYFPEPVTVSWN<br>SGALTSGVHTFPAVLQSSGLYSLSSVVTVPSSSLGTKTYTCNVDHKPSNTKVDKRV<br>ESKYGPPCPPCPAPELAGAPSVFLFPPKPKDTLMISRTPEVTCVVVDVSQEDPEVQF<br>NWYVDGVEVHNAKTKPREEQFNSTYRVVSVLTVLHQDWLNGKEYKCKVSNKGLP<br>SSIEKTISKAKGQPREPQVYTLPPSQEEMTKNQVSLTCLVKGFYPSDIAVEWESNG<br>QPENNYKTTPPVLDSDGSFFLYSRLTVDKSRWQEGNVFSCSVMHEALHNHYTQKS<br>LSLSLGK |
| 48 | Mutated 1D05-HC mutant 2 | Amino acid sequence of 1D05 heavy chain with F to S back-mutation in framework region to germline highlighted with IgG1 disabled (LAGA) constant region | EVQLVESGGGLVQPGRSLRLSCAASGFTFDDYAMHVWRQVPGKGLEWVSGISWI<br>RTGIGYADSVKGRFTISRDNAKNSLYLQMNSLRAEDTALYYCAKDMKGSGTYGGW<br>FDTWGQGTLVWSSASTKGPSVFPLAPCSRSTSESTAALGCLVKDYFPEPVTVSWN<br>SGALTSGVHTFPAVLQSSGLYSLSSVVTVPSSSLGTKTYTCNVDHKPSNTKVDKRV<br>ESKYGPPCPPCPAPELAGAPSVFLFPPKPKDILMISRTPEVTCVVVDVSQEDPEVQF<br>NWYVDGVEVHNAKTKPREEQFNSTYRVVSVLTVLHQDWLNGKEYKCINSNKGLP<br>SSIEKTISKAKGQPREPQVYTLPPSQEEMTKNQVSLTCLVKGFYPSDIAVEWESNG<br>QPENNYKTTPPVLDSDGSFFLYSRLTVDKSRWQEGNVFSCSVMHEALHNHYTQKS<br>LSLSLGK |
| 49 | Mutated 1D05-HC mutant 3 | Amino acid sequence of 1D05 heavy chain with ELLG to -PVA back-mutation in constant region to germline highlighted | EVQLVESGGGLVQPGRSLRLSCAASGFTFDDYAMHWVRQVPGKGLEWVSGISWI<br>RTGIGYADSVKGRFTIFRDNAKNSLYLQMNSLRAEDTALYYCAKDMKGSGTYGGW<br>FDTWGQGTLVTVSSASTKGPSVFPLAPCSRSTSESTAALGCLVKDYFPEPVTVSWN<br>SGALTSGVHTFPAVLQSSGLYSLSSVVTVPSSSLGTKTYTCNVDHKPSNTKVDKRV<br>ESKYGPPCPPCPAP-<br>PVAGPSVFLFPPKPKDTLMISRTPEVTCVVVDVSQEDPEVQFNWYVDGVEVHNAK<br>TKPREEQFNSTYRVVSVLTVLHQDWLNGKEYKCKVSNKGLPSSIEKTISKAKGQPR<br>EPQVYTLPPSQEEMTKNQVSLTCLVKGFYPSDIAVEWESNGQPENNYKTTPPVLDS<br>DGSFFLYSRLTVDKSRWQEGNVFSCSVMHEALHNHYTQKSLSLSLGK |
| 50 | Mutated 1D05-LC mutant 1 | Amino acid sequence of 1D05 kappa light chain with V to A back-mutation in CDRL2 to germline highlighted | DIQMTQSPSSLSASVGDRVTITCRASQSISSYLNWYQQKPGKAPKLLIYAASSLQS<br>GVPSRFSGSGSGTDFTLTISSLQPEDFATYYCQQSYSTPITFGQGTRLEIKRTVAAP<br>SVFIFPPSDEQLKSGTASVVCLLNNFYPREAKVQWKVDNALQSGNSQESVTEQDSK<br>DSTYSLSSTLTLSKADYEKHKVYACEVTHQGLSSPVTKSFNRGEC |
| 51 | Mutated 1D05-LC mutant 2 | Amino acid sequence of 1D05 kappa light chain with L to F back-mutation in framework to germline highlighted | DIQMTQSPSSLSASVGDRVTITCRASQSISSYLNWYQQKPGKAPKLFIYVASSLQS<br>GVPSRFSGSGSGTDFILTISSLQPEDFATYYCQQSYSTPITFGQGTRLEIKRTVAAP<br>SVFIFPPSDEQLKSGTASVVCLLNNFYPREAKVQWKVDNALQSGNSQESVTEQDSK<br>DSTYSLSSTLTLSKADYEKHKVYACEVTHQGLSSPVTKSFNRGEC |
| 52 | 411B08-CDRH1 (IMGT) | Amino acid sequence of CDRH1 of 411B08 using IMGT | GFTFSSYW |

-continued

SEQUENCE LISTING

| SEQ ID NO: | Name | Description | Sequence |
|---|---|---|---|
| 53 | 411B08-CDRH2 (IMGT) | Amino acid sequence of CDRH2 of 411B08 using IMGT | IKEDGSEK |
| 54 | 411B08-CDRH3 (IMGT) | Amino acid sequence of CDRH3 of 411B08 using IMGT | ARNRLYSDFLDN |
| 55 | 411B08-CDRH1 (Kabat) | Amino acid sequence of CDRH1 of 411B08 using Kabat | SYWMS |
| 56 | 411B08-CDRH2 (Kabat) | Amino acid sequence of CDRH2 of 411B08 using Kabat | NIKEDGSEKYYVDSVKG |
| 57 | 411B08-CDRH3 (Kabat) | Amino acid sequence of CDRH3 of 411B08 using Kabat | NRLYSDFLDN |
| 58 | 411B08-Heavy chain variable region | Amino acid sequence of $V_H$ of 411B08 | EVQLVESGGGLVQPGGSLRLSCAASGFTESSYWMSWVRQAPGKGLEWVANIKED GSEKYYVDSVKGRFTISRDNAKNSLYLQMNSLRAEDTSVYYCARNRLYSDFLDNW GQGTLVTVSS |
| 59 | 411B08-Heavy chain variable region | Nucleic acid sequence of $V_H$ of 411B08 | GAGGTGCAGCTGGTGGAGTCTGGGGGAGGCTTGGTCCAGCCTGGGGGGTCCCT GAGACTCTCCTGTGCAGCCTCTGGATTCACGTTTAGTAGCTATTGGATGAGTTG GGTCCGCCAGGCTCCAGGGAAGGGGCTGGAGTGGGTGGCCAACATCAAAGAAG ATGGAAGTGAGAAATACTACTGTGTCGACTCTGTGAAGGGCCGATTCACCATCTCA GAGACAACGCCAAGAACTCACTGTATCTGCAAATGAACAGCCTGAGAGCCGAGG ACACGTCTGTGTATTACTGTGCGAGAAATCGACTCTACAGTGACTTCCTGACAA CTGGGGCCAGGGAACCCTGGTCACCGTCTCCTCAG |
| 60 | 411B08-full heavy chain sequence | Amino acid sequence of 411B08 heavy chain | EVQLVESGGGLVQPGGSLRLSCAASGFTESSYWMSWVRQAPGKGLEWVANIKED GSEKYYVDSVKGRFTISRDNAKNSLYLQMNSLRAEDTSVYYCARNRLYSDFLDNW GQGTLVTVSSASTKGPSVFPLAPSSKSTSGGTAALGCLVKDYFPEPVTVSWNSGAL TSGVHTFPAVLQSSGLYSLSSVVTVPSSSLGTQTYICNVNHKPSNTKVDKKVEPKSC DKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAP IEKTISKAKGQPREPQVYTLPPSRDELTKNQVSLTCLVKGFYPSDIAVEWESNGQPE NNYKTTPPVLDSDGSFFLYSKLTVDKSRWQQGNVFSCSVMHEALHNHYTQKSLSL SPGK |
| 61 | 411B08-full heavy chain sequence | Nucleic acid sequence of 411B08 heavy chain | GAGGTGCAGCTGGTGGAGTCTGGGGGAGGCTTGGTCCAGCCTGGGGGGTCCCT GAGACTCTCCTGTGCAGCCTCTGGATTCACGTTTAGTAGCTATTGGATGAGTTG GGTCCGCCAGGCTCCAGGGAAGGGGCTGGAGTGGGTGGCCAACATCAAAGAAG ATGGAAGTGAGAAATACTACTGTGTCGACTCTGTGAAGGGCCGATTCACCATCTCCA GAGACAACGCCAAGAACTCACTGTATCTGCAAATGAACAGCCTGAGAGCCGAGG ACACGTCTGTGTATTACTGTGCGAGAAATCGACTCTACAGTGACTTCCTTGACAA CTGGGGCCAGGGAACCCTGGTCACCGTCTCCTCAGCAGCACCAAGGGCCCCTC TGTGTTCCCCTCGGTGAAGGACTACTTCCCCGAGCCCGTGACCGTGTCCTGGAACTC GGGCTGCCTCGTGAAGGACTACTTCCCCGAGCCCGTGACCGTGTCCTGGAACTC TGGCGCTCTGACCAGCGGAGTGCACACCTTCCCTGCTGTGCTGCAGTCCTCCGG |

| SEQ ID NO: | Name | Description | Sequence |
|---|---|---|---|
| | | | CCTGTACTCCCTGTCTCCTCGTCGTGACCGTCCTTCCAGCTCTGGCACCCA GACCTACATCTGCAACGTGAACCACAAGCCCTCCAACACCAAGGTGGACAAGAA GGTGAACCCAAGTCCTGCGACAAGAGACCCACAACCTGTCCCCCTGTCCTGCCCC TGAACTGCTGGGCGGACCTTCCGTGTTCCTGTTCCCCCCAAAGCCAAGGACAC CCTGATGATCTCCCGGACCCCCGAAGTGACCTGCGTGGTGGATGTGTCCCA CGAGGACCCTGAAGTGAAGTTCAATTGGTACGTGGACGGCGTGGAAGTGCACAA CGCCAAGACAAGCCTAGAGGAACAGTACAACTCCACCTACCGGGTGGTGTC GGTGCTGACCGTGCTGCACCAGGATTGGCTGAACGGCAAAGAGTACAAGTGCAA GGGCCCAGCCCCGGAACCCTGCCTGCCCCCATCGAAAAGACCATCTCCAAGGCCAA GACCAAGAACCAGGTGTCCCTGACCTGTCTGGTGAAGGGCTTCTACCCTTCGA TATCGCCGTGGAATGGGAGTCCAACGGCCAGCCTGAGAACAACTACAAGACCAC CCCCCTGTGCTGGACTCCGACGGCTCATTCTTCCTGTACAGCAAGCTGACAGT GGACAAGTCCGGTGGCAGCAGGCAACGTGTTCTCCTGCTCCGTGATGCACGA GGCCCTGCACAACCACTACACCCAGAAGTCCCTGTCCCTGAGCCCCGGCAAG |
| 62 | 411B08-CDRL1 (IMGT) | Amino acid sequence of CDRL1 of 411B08 using IMGT | QGVSSW |
| 63 | 411B08-CDRL2 (IMGT) | Amino acid sequence of CDRL2 of 411B08 using IMGT | GAS |
| 64 | 411B08-CDRL3 (IMGT) | Amino acid sequence of CDRL3 of 411B08 using IMGT | QQANSIPFT |
| 65 | 411B08-CDRL1 (Kabat) | Amino acid sequence of CDRL1 of 411B08 using Kabat | RASQGVSSWLA |
| 66 | 411B08-CDRL2 (Kabat) | Amino acid sequence of CDRL2 of 411B08 using Kabat | GASSLQS |
| 67 | 411B08-CDRL3 (Kabat) | Amino acid sequence of CDRL3 of 411B08 using Kabat | QQANSIPFT |
| 68 | 411B08-Light chain variable region | Amino acid sequence of V$_L$ of 411B08 | DIQMTQSPSSVSASVGDRVTITCRASQGVSSWLAWYQQKSGKAPKLLIYGASSLQ SGVPSRFSGSGSGTEFILTISSLQPEDFATYYCQQANSIPFTFGPGTKVDIK |
| 69 | 411B08-Light chain variable region | Nucleic acid sequence of V$_L$ of 411B08 | GACATCCAGATGACCCAGTCTCCATCTTCCGTGTCTGCATCTGTCGGAGACAGA GTCACCATCACTTGTCGGGCGAGTCAGGGTGTTAGCAGCTGGTTAGCCTGGTAT CAGCAGAAATCAGGGAAAGCCCCTAAGCTCCTGATCTATGGTGCATCCAGTTTG |

| SEQ ID NO: | Name | Description | Sequence |
|---|---|---|---|
| | | | CAAAGTGGGGTCCCATCAAGATTCAGCGGCAGTGGATCTGGGACAGAGTTCATT CTCACCATCAGCAGCCTGCAGCCTGAAGATTTTGCAACTTACTATTGTCAACAGG CTAACAGTATCCCATTCACTTTCGGCCCTGGGACCAAAGTGGATATCAAAC |
| 70 | 411B08-full light chain sequence | Amino acid sequence of 411B08 light chain | DIQMTQSPSSVSASVGDRVTITCRASQGVSSWLAWYQQKSGKAPKLLIYGASSLQ SGVPSRFSGSGSGTEFLTISSLQPEDFATYCQQANSIPFTFGPGTKVDIKRTVAAP SVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 71 | 41B08-full light chain sequence | Nucleic acid sequence of 411B08 light chain | GACATCCAGATGACCCAGTCTCCATCTTCCGTGTCTGCATCTGTCGGAGACAGA GTCACCATCACTTGTCGGGCGAGTCAGGGTGTTAGCAGCTGGTTAGCCTGGTAT CAGCAGAAATCAGGGAAAGCCCCTAAGCTCCTGATCTATGGTGCATCCAGTTTG CAAAGTGGGGTCCCATCAAGATTCAGCGGCAGTGGATCTGGGACAGAGTTCATT CTCACCATCAGCAGCCTGCAGCCTGAAGATTTTGCAACTTACTATTGTCAACAG GCTAACAGTATCCCATTCACTTTCGGCCCTGGGACCAAAGTGGATATCAAACGTAC GGTGGCCGCTCCCTCCGTCTTCATCTTCCCACCTTCCGACGAGCAGCTGAAGTC CGGCACCGCTTCTGTCGTGTGCCTGCTGAACAACTTCTACCCCCGCGAGGCCAA GGTGCAGTGGAAGGTGGACAACGCCCTGCAGTCCGGCAACTCCCAGGAATCCGT GACCGAGCAGGACTCCAAGGACAGCACCTACTCCCTGTCCTCCACCCTGACCCT GTCCAAGGCCGACTACGAGAAGCACAAGGTGTACGCCTGCGAAGTGACCCACCA GGGCCTGTCTAGCCCCGTGACCAAGTCTTTCAACCGGGGCGAGTGT |
| 72 | 411C04-CDRH1 (IMGT) | Amino acid sequence of CDRH1 of 411C04 using IMGT | GFTFSSYW |
| 73 | 411C04-CDRH2 (IMGT) | Amino acid sequence of CDRH2 of 411C04 using IMGT | IKEDGSEK |
| 74 | 411C04-CDRH3 (IMGT) | Amino acid sequence of CDRH3 of 411C04 using IMGT | ARVRLYSDFLDY |
| 75 | 411C04-CDRH1 (Kabat) | Amino acid sequence of CDRH1 of 411C04 using Kabat | SYWMS |
| 76 | 411C04-CDRH2 (Kabat) | Amino acid sequence of CDRH2 of 411C04 using Kabat | NIKEDGSEKYVDSLKG |
| 77 | 411C04-CDRH3 (Kabat) | Amino acid sequence of CDRH3 of 411C04 using Kabat | VRLYSDFLDY |
| 78 | 411C04-Heavy chain variable region | Amino acid sequence of V$_H$ of 411C04 | EVQLVDSGGGLVQPGGSLRLSCAASGFTFSSYWMSWVRQAPGKGLEWVANIKED GSEKYVDSLKGRFTISRDNAKNSLYLQMNSLRAEDTSVYYCARVRLYSDFLDYWG QGTLVTVSS |
| 79 | 411C04-Heavy chain variable region | Nucleic acid sequence of V$_H$ of 411C04 | GAGGTGCAGCTGGTGGACTCTGGGGGAGGCTTGGTCCAGCCTGGGGGGTCCCT GAGACTCTCCTGTGCAGCCTCTGGATTCACGTTTAGTAGCTATTGGATGAGTTG GGTCCGCCAGGCTCCAGGGAAGGGGCTGGAGTGGGTGGCCAACATAAAAGAAG |

| SEQ ID NO: | Name | Description | Sequence |
|---|---|---|---|
| 80 | 411C04-full heavy chain sequence | Amino acid sequence of 411C04 heavy chain | EVQLVDSGGGLVQPGGSLRLSCAASGFTFSSYWMSWVRQAPGKGLEWVANIKED GSEKYYVDSLKGRFTISRDNAKNSLYLQMNSLRAEDTSVYYCARVRLYSDFLDYWG QGTLVTVSSASTKGPSVFPLAPSSKSTSGGTAALGCLVKDYFPEPVTVSWNSGALT SGVHTFPAVLQSSGLYSLSSVVTVPSSSLGTQTYICNVNHKPSNTKVDKKVEPKSCD KTHTCPPCPAPELLGGPSVFLFPPKPKDTLMISRTPEVTCVVVDVSHEDPEVKFNWY VDGVEVHNAKTKPREEQYNSTYRWSVLTVLHQDWLNGKEYKCKVSNKALPAPIE KTISKAKGQPREPQVYTLPPSRDELTKNQVSLTCLVKGFYPSDIAVEWESNGQPEN NYKTTPPVLDSDGSFFLYSKLTVDKSRWQQGNVFSCSVMHEALHNHYTQKSLSLS PGK |
| 81 | 411C04-full heavy chain sequence | Nucleic acid sequence of 411C04 heavy chain | GAGGTGCAGTTGGTGGACTCTGGGGGAGGCTTGGTCCAGCCTGGGGGGTCCCT GAGACTCTCCTGTGCAGCCTCTGGATTCACGTTTAGTAGCTATTGGATGAGTTG GGTCCGCCAGGCTCCAGGGAAGGGGCTGGAGTGGGTGGCCAACATAAAGAAG ATGGAAGTGAGAAATACTATGTAGACTCTTTGAAGGGCCGATTCACCATCTCCA GAGACAACGCCAAGAACTCACTGTATCTGCAAATGAACAGCCTGAGAGCCGAGG ACACGTCTGTATTACTGTGCGAGAGTTCGACTTTACAGTGACTTCCTTGACTA CTGGGGCCAGGGAACCCTGGTCACCGTCTCCTCAGCCAGCACCAAGGGCCCCTC TGTGTTCCCTCTGGCCCCCTGCTGAAGGACTACTTCCCCGAGCCTGTGACCGTCTC GGCCTGCCCAGGAACTCCCACCTCCGGGCCTGTGACCGTGTCCTGAACTC CCTGTACTCCCTGTCCTGTGACCAGCGGAGTGCACACTTCACGTTTCCAGTGGCGACCCA GACCTACATCTGCAACGTGAACCACAAGCCCTCAACACCAAGGTGACAAGAA GGTGGAACCCAAGTCCTGCGACAAGTCTCACACATGCCCCCAGAGCTGCTGTGG TGAACTGCTGGGCGGACCTTCCTGTTCCTGTTCCCCCCAAAGCCCAAGGACAC CCTGATGATCTCCCGGACCCCCGAAGTGACCTGCGTGGTGGTGGATGTGTCCCA CGAGGACCCCGAAGTCAATTGGTACGTGGACGGCGTGGAAGTGCACAA CGCCAAGACAAGCCTAGAGAGGAACAGTACAACTCCACCTACCGGGTGTGTC CGTGCTGACCGTCTGCACCAGGCCTGCCCCATCGAACGGCAAAGACCATCTCCAAGGCCAA GGGCCAGCCCCGGGAACCCCAGGTGTACACACTGCCCCCTAGCAGGGACGAGCT GACCAAGAACCAGGTGTCCCTGACCTGTCTGGTGAAAGGCTTCTACCCCTCGA TATCGCCGTGGAATGGGAGTCCAACGGCCAGCCTGAGAACAACTACAAGACCAC CCCCCCTGTGCTGGACTCCGACGGCAGCTTCTTCCTGTACAGCAAGCTGACAGT GGACAAGTCCCGGTGCAGCAGGGCAACGTGTTCTCCTGCTCCGTGATGCACGA GGCCCTGCACAACCACTACACCCAGAAGTCCCTGTCCCTGAGCCCCGGCAAG |
| 82 | 411C04-CDRL1 (IMGT) | Amino acid sequence of CDRL1 of 411C04 using IMGT | QGVSSW |
| 83 | 411C04-CDRL2 (IMGT) | Amino acid sequence of CDRL2 of 411C04 using IMGT | GAS |

-continued

SEQUENCE LISTING

| SEQ ID NO: | Name | Description | Sequence |
|---|---|---|---|
| 84 | 411C04-CDRL3 (IMGT) | Amino acid sequence of CDRL3 of 411C04 using IMGT | QQANSIPFT |
| 85 | 411C04-CDRL1 (Kabat) | Amino acid sequence of CDRL1 of 411C04 using Kabat | RASQGVSSWLA |
| 86 | 411C04-CDRL2 (Kabat) | Amino acid sequence of CDRL2 of 411C04 using Kabat | GASSLQS |
| 87 | 411C04-CDRL3 (Kabat) | Amino acid sequence of CDRL3 of 411C04 using Kabat | QQANSIPFT |
| 88 | 411C04-Light chain variable region | Amino acid sequence of V<sub>L</sub> of 411C04 | DIQMTQSPSSVSASVGDRVTITCRASQGVSSWLAWYQQKSGKAPKLLIYGASSLQ SGVPSRFSGSGSGTEFILSISSLQPEDFATYYCQQANSIPFTFGPGTKVDIK |
| 89 | 411C04-Light chain variable region | Nucleic acid sequence of V<sub>L</sub> of 411C04 | GACATCCAGATGACCCAGTCTCCATCTTCCGTCTGCATCTGTCGGAGACAGA GTCACCATCACTTGTCGGGCAGTCAGGGTGTTAGCAGTTGGTTAGCCTGTAT CAGCAGAAATCAGGGAAAGCCCCTAAGCTCCTGATCTATGGTGCCTCCAGTTTG CAAAGTGGGGTCCCATCAAGATTCAGCGGCAGTGGATCTGGGACAGAGTTCATT CTCAGCATCAGCAGCCTGCAGCCTGAAGATTTTGCAACTTACTATTGTCAACAGG CTAACAGTATCCCATTCACTTTCGGCCCTGGGACCAAAGTGGATATCAAAC |
| 90 | 411C04-full light chain sequence | Amino acid sequence of 411C04 light chain | DIQMTQSPSSVSASVGDRVTITCRASQGVSSWLAWYQQKSGKAPKLLIYGASSLQ SGVPSRFSGSGSGTEFILSISSLQPEDFATYYCQQANSIPFTFGPGTKVDIKRTVAAP SVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 91 | 411C04-full light chain sequence | Nucleic acid sequence of 411C04 light chain | GACATCCAGATGACCCAGTCTCCATCTTCCGTCTGCATCTGTCGGAGACAGA GTCACCATCACTTGTCGGGCAGTCAGGGTGTTAGCAGTTGGTTAGCCTGTAT CAGCAGAAATCAGGGAAAGCCCCTAAGCTCCTGATCTATGGTGCCTCCAGTTTG CAAAGTGGGGTCCCATCAAGATTCAGCGGCAGTGGATCTGGGACAGAGTTCATT CTCAGCATCAGCAGCCTGCAGCCTGAAGATTTTGCAACCAAAGTGGATATCAAACGTAC CTAACAGTATCCCATTCACTTTCGGCCCTGTTCATCTTCCGACTTCCGACAGCAGCTGAAGTC CGGCACCGCTTCTGTGTGCCTGCTGAACAACTTCTACCCCCGCGAGGCCAA GGTGCAGTGGAAGGTGGACAACGCCCTGCAGTCTGGCAACTCCCAGGAATCCGT GACCGAGCAGGACTCCAAGGACAGCACCTACAGCCTCCTCCACCCTGACCCT GTCCAAGGCCGACTACGCCCCGTGACCAAGAGCAACAAAGGTGTACGCCTGCGAAGTGACCCACCA GGGCCTGTCTAGCCCCGTGACCAAGTCTTTCAACCGGGCGAGTGT |
| 92 | 411D07-CDRH1 (IMGT) | Amino acid sequence of CDRH1 of 411D07 using IMGT | GGSIISSDW |

SEQUENCE LISTING

| SEQ ID NO: | Name | Description | Sequence |
|---|---|---|---|
| 93 | 411D07-CDRH2 (IMGT) | Amino acid sequence of CDRH2 of 411D07 using IMGT | IFHSGRT |
| 94 | 411D07-CDRH3 (IMGT) | Amino acid sequence of CDRH3 of 411D07 using IMGT | ARDGSGSY |
| 95 | 411D07-CDRH1 (Kabat) | Amino acid sequence of CDRH1 of 411D07 using Kabat | SSDWWN |
| 96 | 411D07-CDRH2 (Kabat) | Amino acid sequence of CDRH2 of 411D07 using Kabat | EIFHSGRTNYNPSLKS |
| 97 | 411D07-CDRH3 (Kabat) | Amino acid sequence of CDRH3 of 411D07 using Kabat | DGSGSY |
| 98 | 411D07-Heavy chain variable region | Amino acid sequence of V$_H$ of 411D07 | QVQLQESGPGLVKPSGTLSLTCIVSGGSTISSDWWNWVRQPPGKGLEWIGEIFHS GRTNYNPSLKSRVTISIDKSKNQFSLRLSSVTAADTAVYYCARDGSGSYWGQGTLV TVSS |
| 99 | 411D07-Heavy chain variable region | Nucleic acid sequence of V$_H$ of 411D07 | CAGGTCCAGCTGCAGGAGTCGGGCCCAGGACTGGTGAAGCCTTCGGGACCCT GTCCCTCACCTGCATTGTCTCTGGTGGCTCCATCATCAGTAGTGACTGGTGGAA TTGGGTCCGCCAGCCCCCAGGGAAGGGGCTGGAGTGGATTGGAGAAATCTTTC ATAGTGGGAGGACCAACTACAACCCGTCCCTCAAGAGTCGAGTCACCATATCAA TAGACAAGTCCAAGAATCAGTTCTCCTGAGGCTGAGCTCTGTGACCGCCGCGG ACACGGCCGTGTATTACTGTGCGAGAGATGGTTCGGGGAGTTACTGGGGCCAG GGAACCCTGGTCACCGTCTCCTCAG |
| 100 | 411D07-full heavy chain sequence | Amino acid sequence of 411D07 heavy chain | QVQLQESGPGLVKPSGTLSLTCIVSGGSTISSDWWNWVRQPPGKGLEWIGEIFHS GRTNYNPSLKSRVTISIDKSKNQFSLRLSSVTAADTAVYYCARDGSGSYWGQGTLV TVSSASTKGPSVFPLAPSSKSTSGGTAALGCLVKDYFPEPVTVSWNSGALTSGVHT FPAVLQSSGLYSLSSVVTVPSSSLGTQTYICNVNHKPSNTKVDKKVEPKSCDKTHTC PPCPAPELLGGPSVFLFPPKPKDTLMISRTPEVTCVVVDVSHEDPEVKFNWYVDGV EVHNAKTKPREEQYNSTYRVVSVLTVLHQDWLNGKEYKCKVSNKALPAPIEKTISK AKGQPREPQVYTLPPSRDELTKNQVSLTCLVKGFYPSDIAVEWESNGQPENNYKTT PPVLDSDGSFFLYSKLTVDKSRWQQGNVFSCSVMHEALHNHYTQKSLSLSPGK |
| 101 | 411D07-full heavy chain sequence | Nucleic acid sequence of 411D07 heavy chain | CAGGTCCAGCTGCAGGAGTCGGGCCCAGGACTGGTGAAGCCTTCGGGACCCT GTCCCTCACCTGCATTGTCTCTGGTGGCTCCATCATCAGTAGTGACTGGTGGAA TTGGGTCCGCCAGCCCCCAGGGAAGGGGCTGGAGTGGATTGGAGAAATCTTTC ATAGTGGGAGGACCAACTACAACCCGTCCCTCAAGAGTCGAGTCACCATATCAA TAGACAAGTCCAAGAATCAGTTCTCCTGAGGCTGAGCTCTGTGACCGCCGCGG ACACGGCCGTGTATTACTGTGCGAGAGATGGTTCGGGGAGTTACTGGGGCCAG GGAACCCTGGTCACCGTCTCCTCAGCTAGCACCAAGGGCCCATCGGTCTTCCCT CTGGCCCCCTCCAGCACTCTCCCGAGCCTGTGACCTGTCCTGGGAACAGCGCCCTG GTGAAGGACTACTTCCCCGAGCCTGTGACCGTGTCCTGGAACTCTGGCGCTCTG ACCAGCGGAGTGCACACCTTCCCAGCTGTCCTGCAGTCCTCCGGCCTGTACTCC CTGTCCTCCGTCGTGACCGTGCCTTCCAGCTCTCTGGGCACCCAGACCTACATC |

| SEQ ID NO: | Name | Description | Sequence |
|---|---|---|---|
| | | | TGCAACGTGAACCACAAGCCCTCCAACACCAAGGTGGACAAGAAGGTGGAACCC |
| | | | AAGTCCTGCGACAAGACCCACACCTGTCCCCCCCAAAGCCCAAGGACACCCTGATG |
| | | | GGCGGACCTTCCGTGTTCCTGTTCCCCCCCAAAGCCCAAGGACACCCTGATGATC |
| | | | TCCCGGACCCCCGAAGTGACCTGCGTGGTGGTGGATGTGTCCACGAGGACCCT |
| | | | GAAGTGAAGTTCAATTGGTACGTGGACGGCGTGGAAGTGCACAACGCCAAGACC |
| | | | AAGCCTAGAGAGGAACAGTACAACTCCACCTACCGGGTGGTGTCCGTGCTGACC |
| | | | GTGCTGCACCAGGATTGGCTGAACGGCAAAGAGTACAAGTGCAAGGTGTCCAAC |
| | | | AAGGCCCTGCCTGCCCCCATCGAAAAGACCATCTCCAAGGCCAAGGGCCAGCCC |
| | | | CGGGAACCCCAGGTGTACACACTGCCCCCTAGCCAGGAGGAGATGACCAAGAAC |
| | | | CAGGTGTCCCTGACCTGTCTGGTGAAAGGCTTCTACCCCTCCGATATCGCCGTG |
| | | | GAATGGGAGTCCAACGGCCAGCCTGAGAACAACTACAAGACCACCCCCCCTGTG |
| | | | CTGGACTCCGACGGCTCATTCTTCCTGTATAGCAAGCTGACAGTGGACAAGTCC |
| | | | CGGTGGCAGCAGGGCAACGTGTTCTCCTGCTCCGTGATGCACGAGGCCCTGCAC |
| | | | AACCACTACACCCAGAAGTCCCTGTCCCTGAGCCCCGGCAAG |
| 102 | 411D07-CDRL1 (IMGT) | Amino acid sequence of CDRL1 of 411D07 using IMGT | QSVLYSSNNKNY |
| 103 | 411D07-CDRL2 (IMGT) | Amino acid sequence of CDRL2 of 411D07 using IMGT | WAS |
| 104 | 411D07-CDRL3 (IMGT) | Amino acid sequence of CDRL3 of 411D07 using IMGT | QQYYSNRS |
| 105 | 411D07-CDRL1 (Kabat) | Amino acid sequence of CDRL1 of 411D07 using Kabat | KSSQSVLYSSNNKNYLA |
| 106 | 411D07-CDRL2 (Kabat) | Amino acid sequence of CDRL2 of 411D07 using Kabat | WASTRES |
| 107 | 411D07-CDRL3 (Kabat) | Amino acid sequence of CDRL3 of 411D07 using Kabat | QQYYSNRS |
| 108 | 411D07-Light chain variable region | Amino acid sequence of $V_L$ of 411D07 | DIVMTQSPDSLAVSLGERATINCKSSQSVLYSSNNKNYLAWYQQKSGQPPKLLIYW ASTRESGVPDRFSGSGSGTDFTLTISSLQTEDVAVYYCQQYYSNRSFGQGTKLEIK |
| 109 | 411D07-Light chain variable region | Nucleic acid sequence of $V_L$ of 411D07 | GACATCGTGATGACCCAGTCCCCAGACTCCCTGGCTGTCTCTGGCGAGAGG GCCACCATCAACTGCAAGTCCAGCCAGAGTGTTTTATACAGCTCCAACAATAAGA ATTACTTAGCTTGGTACCAGCAGAAATCAGGACAGCCTCCTAAGTTGCTCATTTA CTGGGCATCTACCCGGGAATCCGGGGTCCCTGACCGATTCAGTGGCAGCGGGT CTGGGACAGATTTCACTCTCACCATCAGCAGCCTGCAGACTGAAGATGTGGCAG TTTATTACTGTCAGCAATATTATAGTAATCGCAGTTTTGGCCAGGGGACCAAGCT GGAGATCAAAC |

| SEQ ID NO: | Name | Description | Sequence |
|---|---|---|---|
| 110 | 411D07-full light chain sequence | Amino acid sequence of 411D07 light chain | DIVMTQSPDSLAVSLGERATINCKSSQSVLYSSNNKNYLAWYQQKSGQPPKLLIYW ASTRESGVPDRFSGSGSGTDFTLTISSLQTEDVAVYYCQQYYSNRSFGQGTKLEIK RTVAAPSVFIFPPSDEQLKSGTASVVCLLNNFYPREAKVQWKVDNALQSGNSQESV TEQDSKDSTYSLSSTLTLSKADYEKHKVYACEVTHQGLSSPVTKSFNRGEC |
| 111 | 411D07-full light chain sequence | Nucleic acid sequence of 411D07 light chain | GACATCGTGATGACCCAGTCTCCAGACTCCCTGGCTGTCTCTGGGCGAGAGG GCCACCATCAACTGCAAGTCCAGCCAGAGTGTTTTATACAGCTCCAACAATAAGA ATTACTTAGCTTGGTACCAGCAGAAATCAGGACAGCCTCCTAAGTTGCTCATTTA CTGGGCATCTACCCGGGAATCCGGGGTCCCTGACCGATTCAGTGGCAGCGGT CTGGGACAGATTTCACTCTCACCATCAGCAGCCTGCAGACTGAAGATGTGGCAG TTTATTACTGTCAGCAATATTATAGTAATCGCAGTTTTGGCCAGGGGACCAAGCT GGAGATCAAACGTACGGTGGCCGCTCCCGTCTTCATCTTCCCACCTTCCGA CGAGCAGCTGAAGTCCGGAACTGCCTCTGTCGTGTGCCTGCTGAACAACTTCTA CCCCCGCGAGGCCAAGGTGCAGTGGAAGGTGGACAACGCCCTGCAGTCGGCA ACTCCCAGGAATCCGTGACCGAGCAGGACTCCAAGGACAGCACCTACTCCCTGT CCTCCACCCTGACCCTGTCCAAGGCCGACTACGAGAAGCACAAGGTGTACGCCT GCGAAGTGACCCACCAGGGCCTGTCTAGCCCCGTGACCAAGTCTTTCAACCGGG GCGAGTGT |
| 112 | 385F01-CDRH1 (IMGT) | Amino acid sequence of CDRH1 of 385F01 using IMGT | GFTFSSYW |
| 113 | 385F01-CDRH2 (IMGT) | Amino acid sequence of CDRH2 of 385F01 using IMGT | IKEDGSEK |
| 114 | 385F01-CDRH3 (IMGT) | Amino acid sequence of CDRH3 of 385F01 using IMGT | ARNRLYSDFLDN |
| 115 | 385F01-CDRH1 (Kabat) | Amino acid sequence of CDRH1 of 385F01 using Kabat | SYWMS |
| 116 | 385F01-CDRH2 (Kabat) | Amino acid sequence of CDRH2 of 385F01 using Kabat | NIKEDGSEKYVDSVKG |
| 117 | 385F01-CDRH3 (Kabat) | Amino acid sequence of CDRH3 of 385F01 using Kabat | NRLYSDFLDN |
| 118 | 385F01-Heavy chain variable region | Amino acid sequence of $V_H$ of 385F01 | EVQLVESGGGLVQPGGSLRLSCAASGFTFSSYWMSWVRQAPGKGLEWVANIKED GSEKYVDSVKGRFTISRDNAKNSLYLQMNSLRAEDTSVYYCARNRLYSDFLDNW GQGTLVTVSS |

-continued

SEQUENCE LISTING

| SEQ ID NO: | Name | Description | Sequence |
|---|---|---|---|
| 119 | 385F01-Heavy chain variable region | Nucleic acid sequence of V<sub>H</sub> of 385F01 | GAGGTGCAGCTGGTGGAGTCTGGGGGAGGCTTGGTCCAGCCTGGGGGGTCCCT GAGACTCTCCTGTGCAGCCTCTGGATTCACGTTTAGTAGCTATTGGATGAGTTG GGTCCGCCAGGCTCCAGGGAAGGGCTGGAGTGGGTGGCCAACATCAAAGAAG ATGGAAGTGAGAAATACTATGTCGACTCTGTGAAGGGCCGATTCACCATCTCA GAGACAACGCCAAGAACTCACTGTATCTGCAAATGAACAGCCTGAGAGCCGAGG ACACGTCTGTATTACTGTGCAGAAATCGACTCTACAGTGACTTCCTTGACAA CTGGGCCAGGGAACCCTGGTCACCGTCTCCTCAG |
| 120 | 385F01-full heavy chain sequence | Amino acid sequence of 385F01 heavy chain | EVQLVESGGGLVQPGGSLRLSCAASGFTFSSYWMSWVRQAPGKGLEWVANIKED GSEKYYVDSVKGRFTISRDNAKNSLYLQMNSLRAEDTSVYYCARNRLYSDFLDNW GQGTLVTVSSASTKGPSVFPLAPSSKSTSGGTAALGCLVKDYFPEPVTVSWNSGAL TSGVHTFPAVLQSSGLYSLSSVVTVPSSSLGTQTYICNVNHKPSNTKVDKKVEPKSC DKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAP IEKTISKAKGQPREPQVYTLPPSRDELTKNQVSLTCLVKGFYPSDIAVEWESNGQPE NNYKTTPPVLDSDGSFFLYSKLTVDKSRWQQGNVFSCSVMHEALHNHYTQKSLSL SPGK |
| 121 | 385F01-full heavy chain sequence | Nucleic acid sequence of 385F01 heavy chain | GAGGTGCAGCTGGTGGAGTCTGGGGGAGGCTTGGTCCAGCCTGGGGGGTCCCT GAGACTCTCCTGTGCAGCCTCTGGATTCACGTTTAGTAGCTATTGGATGAGTTG GGTCCGCCAGGCTCCAGGGAAGGGCTGGAGTGGGTGGCCAACATCAAAGAAG ATGGAAGTGAGAAATACTATGTCGACTCTGTGAAGGGCCGATTCACCATCTCA GAGACAACGCCAAGAACTCACTGTATCTGCAAATGAACAGCCTGAGAGCCGAGG ACACGTCTGTGTATTACTGTGCAGAAATCGACTCTACAGTGACTTCCTTGACAA CTGGGCCAGGGAACCCTGGTCACCGTCTCCTCAGCCTCCACCAAGGGCCCCTC TGTTCCCCTGGCACCCTCCTCCAAGAGCACCTCTGGGGGCACAGCGGCCCTGG GCTGCCTGGTCAAGGACTACTTCCCCGAGCCTGTGACCGTGTCCTGGAACTC TGGCGCTCTGACCAGCGGAGTGCACACCTTCCCAGCTGTCCTGCAGTCCTCCG GACTCTACTCCCTGTCCTCCGTGGTGACCGTGCCTTCCAACAGCAAGGTGGACAAGAA GGTGGAACCCAAGTCCTGCGACAAGACCCACACCTGTCCCCCCAAAGCCCAAGGACAC TGAACTGCTGGGCGCAGACCTTCCTGTTCCCTGTTCCCCCAAAGCCCAAGGACAC CCTGATGATCTCCCGGACCCCCGAAGTGACCTGCGTGGTGGTGGATGTGTCCA CGAGGACCCTGAAGTGAAGTTCAATTGGTACGTGGACGGCGTGGAAGTGCACAA CGCCAAGACCAAGCCTAGAGAGGAACAGTACAACTCCACCTACCGGGTGGTGTC CGTGCTGACCGTGCTGCACCAGGATTGGCTGAACGGCAAAGAGTACAAGTGCAA GGTGTCCAACAAGGCCCTGCCTGCCCCCATCGAAAAGACCATCTCCAAGGCCAA GACCAAGAACCAGGTGTCTCCGGAACCCCAGGTGTACACTGCCCCTAGCAGGGAGAGCT TATCCGCGTGACTGCGACTCCGACGGCTCATTCTTCCTGTACAGCAAGCTGACAGT CCCCCTGTGCTGACTCCGACGGCTCATTCTTCCTGTACAGCAAGCTGACAGT GACGACAGTCCCGGTGACTGGCAGCAGGGCAACGTGTTCTCCTGTCCGTGATGCACGA GGCCCTGCACAACCACTACACCCAGAAGTCCCTGTCCCTGAGCCCGGGAAG |
| 122 | 385F01-CDRL1 (IMGT) | Amino acid sequence of CDRL1 of 385F01 using IMGT | QGVSSW |

SEQUENCE LISTING -continued

| SEQ ID NO: | Name | Description | Sequence |
|---|---|---|---|
| 123 | 385F01-CDRL2 (IMGT) | Amino acid sequence of CDRL2 of 385F01 using IMGT | GAS |
| 124 | 385F01-CDRL3 (IMGT) | Amino acid sequence of CDRL3 of 385F01 using IMGT | QQANSIPFT |
| 125 | 385F01-CDRL1 (Kabat) | Amino acid sequence of CDRL1 of 385F01 using Kabat | RASQGVSSWLA |
| 126 | 385F01-CDRL2 (Kabat) | Amino acid sequence of CDRL2 of 385F01 using Kabat | GASSLQS |
| 127 | 385F01-CDRL3 (Kabat) | Amino acid sequence of CDRL3 of 385F01 using Kabat | QQANSIPFT |
| 128 | 385F01-Light chain variable region | Amino acid sequence of V<sub>L</sub> of 385F01 | DIQMTQSPSSVSASVGDRVTITCRASQGVSSWLAWYQQKSGKAPKLLIYGASSLQ SGVPSRFSGSGSGTEFILTISSLQPEDFATYYCQQANSIPFTFGPGTKVDIK |
| 129 | 385F01-Light chain variable region | Nucleic acid sequence of V<sub>L</sub> of 385F01 | GACATCCAGATGACCCAGTCTCCATCTTCCGTGTCTGCATCTGTCGGAGACAGA GTCACCATCACTTGTCGGGCGAGTCAGGGTGTTAGCAGCTGGTTAGCCTGGTAT CAGCAGAAATCAGGGAAAGCCCCTAAGCTCCTGATCTATGGTGCATCCAGTTTG CAAAGTGGGGTCCCATCAAGATTCAGCGGCAGTGGATCTGGGACAGAGTTCATT CTCACCATCAGCAGCCTGCAGCCTGAAGATTTTGCAACTTACTATTGTCAACAGG CTAACAGTATCCCATTCACTTTCGGCCCTGGGACCAAAGTGGATATCAAAC |
| 130 | 385F01-full light chain sequence | Amino acid sequence of 385F01 light chain | DIQMTQSPSSVSASVGDRVTITCRASQGVSSWLAWYQQKSGKAPKLLIYGASSLQ SGVPSRFSGSGSGTEFILTISSLQPEDFAMCQQANSIPFTFGPGTKVDIKRTVAAP SVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 131 | 385F01-full light chain sequence | Nucleic acid sequence of 385F01 light chain | GACATCCAGATGACCCAGTCTCCATCTTCCGTGTCTGCATCTGTCGGAGACAGA GTCACCATCACTTGTCGGGCGAGTCAGGGTGTTAGCAGCTGGTTAGCCTGGTAT CAGCAGAAATCAGGGAAAGCCCCTAAGCTCCTGATCTATGGTGCATCCAGTTTG CAAAGTGGGGTCCCATCAAGATTCAGCGGCAGTGGATCTGGGACAGAGTTCATT CTCACCATCAGCAGCCTGCAGCCTGAAGATTTTGCAACTTACTATTGTCAACAGG CTAACAGTATCCCATTCACTTTCGGCCCTGGGACCAAAGTGGATATCAAACGTAC GGTGGCCGCGCCATCCGTCTTCATCTTCCCGCCATCTGATGAGCAGTTGAAATC TGGAACTGCCTCTGTTGTGTGCCTGCTGAATAACTTCTACCCCCGAGAGCCAA GGTGCAGTGGAAGGTGGACAACGCCCTCCAATCTCGGAGAATCCGT GACCGAGCAGGACTCCAAGGACAGCACCTACTCCCTCAGCAGCACCCTGACCCT GTCCAAGGCCGACTACGAGAAGCACAAAGTGTACGCCTGCGAAGTGACCCACCA GGGCCTGTCTAGCCCCGTGACCAAGTCTTTCAACCGGGGCGAGTGT |

| SEQ ID NO: | Name | Description | Sequence |
|---|---|---|---|
| 132 | 413D08-CDRH1 (IMGT) | Amino acid sequence of CDRH1 of 413D08 using IMGT | GFTFRIYG |
| 133 | 413D08-CDRH2 (IMGT) | Amino acid sequence of CDRH2 of 413D08 using IMGT | IWYDGSNK |
| 134 | 413D08-CDRH3 (IMGT) | Amino acid sequence of CDRH3 of 413D08 using IMGT | ARDMDYFGMDV |
| 135 | 413D08-CDRH1 (Kabat) | Amino acid sequence of CDRH1 of 413D08 using Kabat | IYGMH |
| 136 | 413D08-CDRH2 (Kabat) | Amino acid sequence of CDRH2 of 413D08 using Kabat | VIWYDGSNKYYADSVKG |
| 137 | 413D08-CDRH3 (Kabat) | Amino acid sequence of CDRH3 of 413D08 using Kabat | DMDYFGMDV |
| 138 | 413D08-Heavy chain variable region | Amino acid sequence of V$_H$ of 413D08 | QVQLVESGGGVVQPGRSLRLSCAASGFTFRIYGMHWVRQAPGKGLEWVAVIWYDGSNKYYADSVKGRFTISRDNSDNTLYLQMNSLRAEDTAVYYCARDMDYFGMDVWGQGTTVTVSS |
| 139 | 413D08-Heavy chain variable region | Nucleic acid sequence of V$_H$ of 413D08 | CAGGTGCAGCTGGTGGAGTCTGGGGGAGGCGTGGTCCAGCCTGGGAGGTCCCTGAGACTCTCCTGTGCAGCGTCTGGATTCACCTTCCGTATTTATGGCATGCACTGGGTCCGCCAGGCTCCAGGCAAGGGGCTGGAGTGGGTGGCAGTTATATGGTATGATGGAAGTAATAAATACTATGCTGACTCCGTGAAGGGCCGATTCACCATCTCCAGAGACAATTCCGACAACACGCTGTATCTGCAAATGAACAGCCTGAGACCGAGGACACGGCTGTGTATTACTGTGCGAGAGATATGGACTACTTCGGTATGGACGTCTGGGGCCAAGGGACCACGGTCACCGTCTCCTCAG |
| 140 | 413D08-full heavy chain sequence | Amino acid sequence of 413D08 heavy chain | QVQLVESGGGVVQPGRSLRLSCAASGFTFRIYGMHWVRQAPGKGLEWVAVIWYDGSNKYYADSVKGRFTISRDNSDNTLYLQMNSLRAEDTAVYYCARDMDYFGMDVWGQGTTVTVSSASTKGPSVFPLAPSSKSTSGGTAAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRWSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 141 | 413D08-full heavy chain sequence | Nucleic acid sequence of 413D08 heavy chain | CAGGTGCAGCTGGTGGAGTCTGGGGGAGGCGTGGTCCAGCCTGGGAGGTCCCTGAGACTCTCCTGTGCAGCGTCTGGATTCACCTTCCGTATTTATGGCATGCACTGGGTCCGCCAGGCTCCAGGCAAGGGGCTGGAGTGGGTGGCAGTTATATGGTATGATGGAAGTAATAAATACTATGCTGACTCCGTGAAGGGCCGATTCACCATCTCCAGAGACAATTCCGACAACACGCTGTATCTGCAAATGAACAGCCTGAGACCGAGGACACGGCTGTGTATTACTGTGCGAGAGATATGGACTACTTCGGTATGGACGTCTGGGGCCAAGGGACCACGGTCACCGTCTCCTCAGCCAGCACCAAGGGCCCCTCTG |

TABLE-continued

SEQUENCE LISTING

| SEQ ID NO: | Name | Description | Sequence |
|---|---|---|---|
| | | | TGTTCCCTCTGGCCCCTTCCAGCAAGTCTCCACCTCTGGCGGAACAGCGCTCTGG GCTGCCCTCGTGAAGGACTACTTCCCCGAGCCTGTGACCGTGTCCTGGAACTCTG GCGCTCTGACCAGCGGAGTGCACACCTTCCCTGCTGTGCTGCAGTCCTCCGGCC TGTACTCCCTGTCCTCCGTCGTGACCGTGCCCTCCAGCTCTCTGGGCACCCAGA CCTACATCTGCAACGTGAACCACAAGCCCTCCAACACCAAGGTGGACAAGAAGG TGGAACCCAAGTCTCTGCGACAAGACCCACACCTGTCCCCCCTTGTCTTCCTGA ACTGCTGGGCGGACCTTCCGTGTTCCTGTTCCCCCCAAAGCCCAAGGACACCCT GATGATCTCCCGGACCCCCGAAGTGACCTGCGTGGTGGTGGATGTGTCCCACGA GGACCCTGAAGTGAAGTTCAATTGGTACGTGGACGGCGTGGAAGTGCACAACGC CAAGACCAAGCCTAGAGAAGAACAGTACAACTCTACCTACCGCGTGGTGTCCGT GCTGACCGTGCTGCACCAGGATTGGCTGAACGGCAAGGAGTACAAGTGCAAGGT GTCCAACAAGGCCCTGCCTGCCCCAGGTGTACACCTGCCCCATCGAAAAGACCATCTCCAAGGCCAAGG CCAGCCCCGGAACCCAGGTGTCCCTGACCTGTCTGGTGAAAGGCTTCTACCCCTCCGATAT CGCCGTGGAATGGGAGTCCAACGGCCAGCCTGAGAACAACTACAAGACCACCCC CCCTGTGCTGGACTCCGACGGCTCATTCTTCCTGTACAGCAAGCTGACAGTGGA CAAGTCCGGTTGGCAGCAGGGCAACGTGTTCTCCTGCTCCGTGATGCACGAGGC CCTGCACAACCACTACACCCAGAAGTCCCTGTCCCTGAGCCCCGGCAAG |
| 142 | 413D08-CDRL1 (IMGT) | Amino acid sequence of CDRL1 of 413D08 using IMGT | QGIRND |
| 143 | 413D08-CDRL2 (IMGT) | Amino acid sequence of CDRL2 of 413D08 using IMGT | MS |
| 144 | 413D08-CDRL3 (IMGT) | Amino acid sequence of CDRL3 of 413D08 using IMGT | LQHNSYPRT |
| 145 | 413D08-CDRL1 (Kabat) | Amino acid sequence of CDRL1 of 413D08 using Kabat | RASQGIRNDLG |
| 146 | 413D08-CDRL2 (Kabat) | Amino acid sequence of CDRL2 of 413D08 using Kabat | AASSLQS |
| 147 | 413D08-CDRL3 (Kabat) | Amino acid sequence of CDRL3 of 413D08 using Kabat | LQHNSYPRT |
| 148 | 413D08-Light chain variable region | Amino acid sequence of V_L of 413D08 | DLQMTQSPSSLSASVGDRVTITCRASQGIRNDLGWYQQKPGKAPKRLIYAASSLQS GVPSRFSGSGSGTEFTLTISSLQPEDFATYYCLQHNSYPRTFGQGTKVEIK |
| 149 | 413D08-Light chain variable region | Nucleic acid sequence of V_L of 413D08 | GACCTCCAGATGACCCAGTCTCCATCCTCCCTGTCTGCATCTGTAGGAGACAGA GTCACCATCACTTGCCGGGCAAGTCAGGGCATTAGAAATGATTTAGGCTGGTAT CAGCAGAAACCAGGGAAAGCCCCTAAGCGCCTGATCTATGCTGCATCCAGTTTG CAAAGTGGGGTCCCATCAAGGTTCAGCGGCAGTGGATCTGGGACAGAATTCACT CTCACAATCAGCAGCCTGCAGCCTGAAGATTTTGCAACTTATTACTGTCTACAGC ATAATAGTTACCCTCGGACGTTCGGCCAAGGGACCAAGGTGGAAATCAAAC |

| SEQ ID NO: | Name | Description | Sequence |
|---|---|---|---|
| 150 | 413D08-full light chain sequence | Amino acid sequence of 413D08 light chain | DLQMTQSPSSLSASVGDRVTITCRASQGIRNDLGWYQQKPGKAPKRLIYAASSLQS GVPSRFSGSGSGTEFTLTISSLQPEDFATYYCLQHNSYPRTFGQGTWEIKRTVAAP SVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 151 | 413D08-full light chain sequence | Nucleic acid sequence of 413D08 light chain | GACCTCCAGATGACCCAGTCTCCATCCTCCCTGTCTGCATCTGTAGGAGACAGA GTCACCATCACTTGCCGGGCAAGTCAGGGCATTAGAAATGATTTAGGCTGGTAT CAGCAGAAACCAGGGAAAGCCCCTAAGCGCCTGATCTATGCTGCATCCAGTTTG CAAAGTGGGGTCCCATCAAGGTTCAGCGGCAGTGGATCTGGGACAGAATTCACT CTCACAATCAGCAGCCTGCAGCCTGAAGATTTTGCAACTTATTACTGTCTACAGC ATAATAGTTACCCTCGGACGTTCGGCCAAGGGACCAAGGTGGAAATCAAACGTA CGGTGGCCGCTCCCTCCGTGTTCATCTTCCCACCTTCCGACGAGCAGCTGAAGT CCGGACACCGCTTCTGTGCTCGGCCAGTCGGCAACTTCTACCCCCGGAGGCCA AGGTGCAGTGGAAGGTGGACAACGCCCTGCAGTCCGGCAACTCCCAGGAATCCG TGACCGAGCAGGACTCCAAGGACAGCACCTACTCCCTGTCCTCCACCCTGACC TGTCCAAGGCCGACTACGAGAAGCACAAGGTGTACGCCTGCGAAGTGACCCACC AGGGCCTGTCTAGCCCCGTGACCAAGTCTTTCAACCGGGCGAGTGT |
| 152 | 386H03-CDRH1 (IMGT) | Amino acid sequence of CDRH1 of 386H03 using IMGT | GGSISSSDW |
| 153 | 386H03-CDRH2 (IMGT) | Amino acid sequence of CDRH2 of 386H03 using IMGT | IFHSGNT |
| 154 | 386H03-CDRH3 (IMGT) | Amino acid sequence of CDRH3 of 386H03 using IMGT | VRDGSGSY |
| 155 | 386H03-CDRH1 (Kabat) | Amino acid sequence of CDRH1 of 386H03 using Kabat | SSDWWS |
| 156 | 386H03-CDRH2 (Kabat) | Amino acid sequence of CDRH2 of 386H03 using Kabat | EIFHSGNTNYNPSLKS |
| 157 | 386H03-CDRH3 (Kabat) | Amino acid sequence of CDRH3 of 386H03 using Kabat | DGSGSY |
| 158 | 386H03-Heavy chain variable region | Amino acid sequence of $V_H$ of 386H03 | QVQLQESGPGLVKPSGTLSLTCAVSGGSISSSDWSWVRQPPGKGLEWIGEIFHS GNTNYNPSLKSRVTISVDKSKNQISLRLNSVTAADTAVYYCVRDGSGSYWGQGTL VTVSS |
| 159 | 386H03-Heavy chain variable region | Nucleic acid sequence of $V_H$ of 386H03 | CAGGTGCAGCTGCAGGAGTCGGGCCCAGGACTGGTGAAGCCTTCGGGACCCT GTCCCTCACCTGCGCTGTCTGGTGGCTCCATCAGCAGTAGTGACTGGTGGAG TTGGGTCCGCCAGCCCCCAGGGAAGGGCTGGAGTGGATTGGGAAATCTTTC ATAGTGGGAACACCAACTACTACACCCGTTCCCTGAGGCTGAACTCTGTGACCGCCGGA AGACAAGTCCAAGAACCAGATCTCCCTGAGCTGAACTCTGTGACCGCCGGA CACGGCCGTGTATTACTGTGTGAGAGATGGTTCGGGGAGTTACTGGGGCCAGG GAACCCTGGTCACCGTCTCCTCAG |

-continued

SEQUENCE LISTING

| SEQ ID NO: | Name | Description | Sequence |
|---|---|---|---|
| 160 | 386H03-full heavy chain sequence | Amino acid sequence of 386H03 heavy chain | QVQLQESGPGLVKPSETLSLTCAVSGGSISSSDWWSWVRQPPGKGLEWIGEIFHS GNTNYNPSLKSRVTISVDKSKNQISLRLNSVTAADTAVYYCVRDGSGSYWGQGTL VTVSSASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKSCDKTHT CPPCPAPELLGGPSVFLFPPKPKDTLMISRTPEVTCVVVDVSHEDPEVKFNWYVDG VEVHNAKTKPREEQYNSTYRVVSVLTVLHQDWLNGKEYKCKVSNKALPAPIEKTIS KAKGQPREPQVYTLPPSRDELTKNQVSLTCLVKGFYPSDIAVEWESNGQPENNYKT TPPVLDSDGSFFLYSKLTVDKSRWQQGNVFSCSVMHEALHNHYTQKSLSLSPGK |
| 161 | 386H03-full heavy chain sequence | Nucleic acid sequence of 386H03 heavy chain | CAGGTGCAGCTGCAGGAGTCGGGCCCAGGACTGGTGAAGCCTTCGGGACCCT GTCCCTCACCTGCGCTGTCTGGTGGCTCCATCAGCAGTAGTGACTGGTGGAG TTGGGTCCGCCAGCCCCCAGGGAAGGGCTGGAGTGGATTGGGAAATCTTTC ATAGTGGAACACCAACTACAACCCGTCCCTCAAGAGTCGAGTCACCATATCAGT AGACAAGTCCAAGAACCAGATCTCCCTGAGGCTGAACTCTGTGACCGCCGGA CACGGCCGTGTATTACTGTGTGAGAGATGGTTCGGGGAGTTACTGGGGCCAGG GAACCCTGGTCACCGTCTCCTCAGCCAGCACCAAGGGCCCCTCTGTTCCCTC TGGCCCCTCCAGCAAGTCCACCTCTGGGCTGTGTCCTGAACTGCCTGGTCAAG GACTACTTCCCCGAGCCGTGTCTGGAACTCTGGCGCTCTGA CCAGCGGAGTCCACACCTTCCCGGCTGTGCTGCAGTCCTGGGACTCCTACTCC TGTCTCCGTGACCGTGCCTTCAGCTCTCTGGCACCCAGAAGGTGGACCCA AGTCCTGCGACAAGACCCACACCTGTCCCCCTTGTCCCCCTGAACTGCTGG GCGGACCTTCCGTGTTCCTGTTCCCCCAAAGCCCAAGGACACCCTGATGATCT CCCGGACCCCCGAAGTGACCTGCGTGGACGGCGTGGAAGTGCACAACGCCAAGACC AAGCTAGAGAGGAACAGTACAACTCCACCTACCGGGTGGTGTCCGTGCTGACC GTGCTGCACCAGGATTGGCTGAACGGCAAAGAGTACAAGTGCAAGGTGTCCAAC AAGGCCCTGCCTGCCCCATCGAAAAGACCATCTCCAAGGCCAAGGGCCAGCCC CGGGAACCCCAGGTGTACACACTGCCCCCTAGCAGGGACGAGCTGACCAAGAAC CAGGTGTCCCTGACCTGTCTGGTGAAAGGCTTCTACCCCTCCGATATCGCCGTG GAATGGGAGTCCAACGGCCAGCCTGAGAACAACTACAAGACCACCCCCCCTGTG CTGGACTCCGACGGCTCATTCTTCCTGTACTCCAAGCTGACAGTGGACAAGTCC CGGTGGCAGCAGGGCAACGTGTTCTCCTGCTCCGTGATGCACGAGGCCCTGCAC AACCACTACACCCAGAAGTCCCTGTCCCTGAGCCCCGGCAAG |
| 162 | 386H03-CDRL1 (IMGT) | Amino acid sequence of CDRL1 of 386H03 using IMGT | QSVLYSSNNKNY |
| 163 | 386H03-CDRL2 (IMGT) | Amino acid sequence of CDRL2 of 386H03 using IMGT | WAS |
| 164 | 386H03-CDRL3 (IMGT) | Amino acid sequence of CDRL3 of 386H03 using IMGT | QQYYSTRS |
| 165 | 386H03-CDRL1 (Kabat) | Amino acid sequence of CDRL1 of 386H03 using Kabat | KSSQSVLYSSNNKNYLA |

SEQUENCE LISTING -continued

| SEQ ID NO: | Name | Description | Sequence |
|---|---|---|---|
| 166 | 386H03-CDRL2 (Kabat) | Amino acid sequence of CDRL2 of 386H03 using Kabat | WASTRES |
| 167 | 386H03-CDRL3 (Kabat) | Amino acid sequence of CDRL3 of 386H03 using Kabat | QQYYSTRS |
| 168 | 386H03-Light chain variable region | Amino acid sequence of V_L of 386H03 | DIVMTQSPDSLAVSLGERATINCKSSQSVLYSSNNKNYLAWYQQKPGQPPKLLIYW ASTRESGVPDRFSGSGSGTDFTLTISSLQAEDVAVYYCQQYYSTRSFGQGTKLEIK |
| 169 | 386H03-Light chain variable region | Nucleic acid sequence of V_L of 386H03 | GACATCGTGATGACCCAGTCTCCAGACTCTCCTGGCTGTCTCTGGGCGAGAGG GCCACCATCAACTGCAAGTCCAGCCAGAGTGTTTTATACAGCTCCAACAATAAGA ACTACTTAGCTTGGTACCAGCAGAAACCAGGACAGCCTCCTAAACTGCTCATTTA CTGGGCATCTACCCGGGAATCCGGGTCCCTGACCGATTCAGTGGCAGCGGGT CTGGGACAGATTTCACTCTCACCATCAGCAGCCTGCAGGCTGAAGATGTGGCAG TTTATTACTGTCAGCAATATTATAGTACTCCAGTTTTGGCCAGGGGACCAAGCT GGAGATCAAAC |
| 170 | 386H03-full light chain sequence | Amino acid sequence of 386H03 light chain | DIVMTQSPDSLAVSLGERATINCKSSQSVLYSSNNKNYLAWYQQKPGQPPKLLIYW ASTRESGVPDRFSGSGSGTDFTLTISSLQAEDVAVYYCQQYYSTRSFGQGTKLEIK RTVAAPSVFIFPPSDEQLKSGTASVVCLLNNFYPREAKVQWKVDNALQSGNSQESV TEQDSKDSTYSLSSTLTLSKADYEKHKVYACEVTHQGLSSPVTKSFNRGEC |
| 171 | 386H03-full light chain sequence | Nucleic acid sequence of 386H03 light chain | GACATCGTGATGACCCAGTCTCCAGACTCTCCTGGCTGTCTCTGGGCGAGAGG GCCACCATCAACTGCAAGTCCAGCCAGAGTGTTTTATACAGCTCCAACAATAAGA ACTACTTAGATGGTACCAGCAGAAACCAGGACAGCCTCCTAAACTGCTCATTTA CTGGGCATCTACCCGGGAATCCGGGTCCCTGACCGATTCAGTGGCAGCGGGT CTGGGACAGATTTCACTCTCACCATCAGCAGCCTGCAGGCTGAAGATGTGGCAG TTTATTACTGTCAGCAATATTATAGTACTCCAGTTTTGGCCAGGGGACCAAGCT GGAGATCAAACGTACGGTGGCCGCTCCCGTCTTCATCTTCCCACCTTCGA CAGAGCTGAAGTCCGGCACCGCTTCTGTCGTGTGCCTGCTGAACAACTTCTA CCCCCGGAGGCCAAGTGCAGTGGAAGGTGACAACGCCCTGCAGTCCGGCA ACTCCCAGGAATCCGTGACCGAGCAGGACTCCAAGGACAGCACCTACTCCCTGT CCTCACCCTGACCCTGTCCAAGGCCGACTACGAGAAGCACAAGGTGTACGCCT GCGAAGTGACCCACCAGGGCCTGTCTAGCCCCGTGACCAAGTCTTTCAACCGGG GCGAGTGT |
| 172 | 389A03-CDRH1 (IMGT) | Amino acid sequence of CDRH1 of 389A03 using IMGT | GGSISSSSYY |
| 173 | 389A03-CDRH2 (IMGT) | Amino acid sequence of CDRH2 of 389A03 using IMGT | IYSTGYT |
| 174 | 389A03-CDRH3 (IMGT) | Amino acid sequence of CDRH3 of 389A03 using IMGT | AISTAAGPEYFHR |
| 175 | 389A03-CDRH1 (Kabat) | Amino acid sequence of CDRH1 of 389A03 using Kabat | SSSYYCG |

SEQUENCE LISTING

| SEQ ID NO: | Name | Description | Sequence |
|---|---|---|---|
| 176 | 389A03-CDRH2 (Kabat) | Amino acid sequence of CDRH2 of 389A03 using Kabat | SIYSTGYTYNPSLKS |
| 177 | 389A03-CDRH3 (Kabat) | Amino acid sequence of CDRH3 of 389A03 using Kabat | STAAGPEYFHR |
| 178 | 389A03-Heavy chain variable region | Amino acid sequence of V$_H$ of 389A03 | QLQESGPGLVKPSETLSLTCTVSGGSISSSSYYCGWIRQPPGKGLDMIGSIYSTGYT YNPSLKSRVTISIDTSKNQFSCLLLTSVTAADTAVYYCAISTAAGPEYFHRWGQGT LVTVSS |
| 179 | 389A03-Heavy chain variable region | Nucleic acid sequence of V$_H$ of 389A03 | CAGCTGCAGGAGTCGGGCCCAGGCCTGGTGAAGCCTTCGGAGACCCTGTCCTC ACCTGCACTGTCTCTGGTGGCTCCATCAGCAGTAGTAGTTATTACTGCGGCTGG ATCCGCCAGCCCCCTGGGAAGGGGCTGGACTGGATTGGGAGTATCTATTCTACT GGTTACACCTACTACAACCCGTCCCTCAAGAGTCGAGTCACCATTTCCATAGACA CGTCCAAGAACCAGTTCTCATGCCTGATAACTGACCTCTGTGACCGCCAGACA CGGCTGTGTATTACTGTGCGATAAGTACAGCAGCTGGCCCTGAATACTTCCATC GCTGGGGCCAGGGCACCCTGGTCACCGTCTCCTCAG |
| 180 | 389A03-full heavy chain sequence | Amino acid sequence of 389A03 heavy chain | QLQESGPGLVKPSETLSLTCTVSGGSISSSSYYCGWIRQPPGKGLDMIGSIYSTGYT YNPSLKSRVTISIDTSKNQFSCLLLTSVTAADTAVYYCAISTAAGPEYFHRWGQGT LVTVSSASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKSCDKTHT CPPCPAPELLGGPSVFLFPPKPKDTLMISRTPEVTCVVVDVSHEDPEVKFNWYVDG VEVHNAKTKPREEQYNSTYRVVSVLTVLHQDWLNGKEYKCKVSNKALPAPIEKTIS KAKGQPREPQVYTLPPSRDELTKNQVSLTCLVKGFYPSDIAVEWESNGQPENNYKT TPPVLDSDGSFFLYSKLTVDKSRWQQGNVFSCSVMHEALHNHYTQKSLSLSPGK |
| 181 | 389A03-full heavy chain sequence | Nucleic acid sequence of 389A03 heavy chain | CAGCTGCAGGAGTCGGGCCCAGGCCTGGTGAAGCCTTCGGAGACCCTGTCCTC ACCTGCACTGTCTCTGGTGGCTCCATCAGCAGTAGTAGTTATTACTGCGGCTGG ATCCGCCAGCCCCCTGGGAAGGGGCTGGACTGGATTGGGAGTATCTATTCTACT GGTTACACCTACTACAACCCGTCCCTCAAGAGTCGAGTCACCATTTCCATAGACA CGTCCAAGAACCAGTTCTCATGCCTGATAACTGACCTCTGTGACCGCCAGACA CGGCTGTGTATTACTGTGCGCACCCTGTCACCGTCTCCAGCACCAAGGGCCCT CTGTGTTCCCTGCCCCTTGCCCCTGCCAAGTCACCTCTGGCGGACAGCCGCTC TGGGCTGCCTGCTGTGAAGGACTACTTCCCCGAGCCTGTGACCGTGTCGTGGAACT CTGGCGCTCTGACCAGCGGAGTGCACACCTTCCCTGCTGTGCTGCAGTCTCCG GCCTGTACTCCCTGTCCTCGGTGGTGACCGTGCCTTCCAGCTCTCTGGGCACCC AGACCTACATCTGCAACGTGAACCACAAGCCCTCCAACACCAAGGTGGACAAGA AGGTGGAACCCAAGTCCTGCGACAAGACCCACACCTGTCCCCCTGTCCTGCCC CTGAACTGCTGGGCGGACCTTCCGTGTTCCTGTTCCCCCCAAAGCCAAGGACA CCCTGATGATCTCCCGGACCCCCGAAGTGACCTGCGTGGTGGTGGATGTGTCCC ACGAGGACCCTGAAGTGAAGTTCAATTGGTACGTGGACGGCGTGGAAGTGCACA ACGCCAAGACCAAGCCTAGAGAGGAACAGTACAACTCCACCTACCGGGTGGT CCGTGCTGACCGTGCTGCACCAGGATTGGCTGAACGGCAAAGAGTACAAGTGCA AGGTGTCCAACAAGGCCCTGCCCGCCCCATCGAAAAGACCATCTCCAAGGCCA AGGGCCAGCCCCGGGAACCCCAGGTGTACACACTGCCCCCTAGCAGGACGAGC |

| SEQ ID NO: | Name | Description | Sequence |
|---|---|---|---|
| | | | TGACCAAGAACCAGGTGTCCTGACCTGTCTCTGTGAAAGGCTTCTACCCTCCG ATATCGCGTGGAATGGAGTCCAGACGGTCAGCCTGAGAACAACTACAAGACCA CCCCCCTGTCTGACTCCGACGGCTCATTCTTCCTGTACAGCAAGCTGACAG TGGACAAGTCCCGGTGCAGCAGGGCAACGTGTTCTCCTGCTCCGTGATGCACG AGGCCCTGCACAACCACTACACCCAGAAGTCCCTGTCCCTGAGCCCGGCAAG |
| 182 | 389A03-CDRL1 (IMGT) | Amino acid sequence of CDRL1 of 389A03 using IMGT | QSVLYSSNSKNF |
| 183 | 389A03-CDRL2 (IMGT) | Amino acid sequence of CDRL2 of 389A03 using IMGT | WAS |
| 184 | 389A03-CDRL3 (IMGT) | Amino acid sequence of CDRL3 of 389A03 using IMGT | QQYYSTPRT |
| 185 | 389A03-CDRL1 (Kabat) | Amino acid sequence of CDRL1 of 389A03 using Kabat | KSSQSVLYSSNSKNFLA |
| 186 | 389A03-CDRL2 (Kabat) | Amino acid sequence of CDRL2 of 389A03 using Kabat | WASTRGS |
| 187 | 389A03-CDRL3 (Kabat) | Amino acid sequence of CDRL3 of 389A03 using Kabat | QQYYSTPRT |
| 188 | 389A03-Light chain variable region | Amino acid sequence of V$_L$ of 389A03 | DIVMTQSPDSLAVSLGERATINCKSSQSVLYSSNSKNFLAWYQQKPGQPPKLFIYW ASTRGSGVPDRISGSGSGTDFNLTISSLQAEDVAVYYCQQYYSTPRTFGQGTKVEI K |
| 189 | 389A03-Light chain variable region | Nucleic acid sequence of V$_L$ of 389A03 | GACATCGTGATGACCCAGTCTCCAGACTCCCTGGCTGTCTCTGGGCGAGAGG GCCACCATCAACTGCAAGTCCAGTCAGAGTGTTTTATACAGCTCCAACAGTAAGA ACTTCTTAGCTTGGTACCAGCAGAAACCGGGACAGCCTCCTAAGCTGTTCATTTA CTGGGCATCTACCCGGGATCCGGGTCCCTGACCGAATCAGTGGCAGCGGGT CTGGGACAGATTTCAATCTCACCATCAGCAGCCTGCAGGCTGAAGATGTGCAG TTTATTACTGTCAACAATATTATAGTACTCCTCGGACGTTCGGCCAAGGACCAA GGTGGAGATCAAAC |
| 190 | 389A03-full light chain sequence | Amino acid sequence of 389A03 light chain | DIVMTQSPDSLAVSLGERATINCKSSQSVLYSSNSKNFLAWYQQKPGQPPKLFIYW ASTRGSGVPDRISGSGSGTDFNLTISSLQAEDVAVYYCQQYYSTPRTFGQGTKVEI KRTVAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC |
| 191 | 389A03-full light chain sequence | Nucleic acid sequence of 389A03 light chain | GACATCGTGATGACCCAGTCTCCAGACTCCCTGGCTGTCTCTGGGCGAGAGG GCCACCATCAACTGCAAGTCCAGTCAGAGTGTTTTATACAGCTCCAACAGTAAGA ACTTCTTAGCTTGGTACCAGCAGAAACCGGGACAGCCTCCTAAGCTGTTCATTTA CTGGGCATCTACCCGGGATCCGGGTCCCTGACCGAATCAGTGGCAGCGGGT CTGGGACAGATTTCAATCTCACCATCAGCAGCCTGCAGGCTGAAGATGTGCAG TTTATTACTGTCAACAATATTATAGTACTCCTCGGACGTTCGGCCAAGGACCAA |

| SEQ ID NO: | Name | Description | Sequence |
|---|---|---|---|
| | | | GGTGGAGATCAAACGTACGGTGGCCGCTCCTCCGTGTTCATCTTCCCACCTTC |
| | | | CGACGAGCAGCTGAAGTCCGGCACCGCCTTCTGTGTCGTGCTGCTGAACAACTT |
| | | | CTACCCCCGCGAGGCCAAGTGCAGTGGAAGGTGGACAACGCCCTGCAGTCCG |
| | | | GCAACTCCCAGGAATCCGTGACCGAGCAGGACTCCAAGGACAGCACCTACTCC |
| | | | TGTCTCCACCTGACCCTGTCCAAGGCGGACTACGAGAAGCACAAGGTGTACG |
| | | | CCTGCGAAGTGACCCACCAGGGCCTGTCTAGCCCCGTGACCAAGTCTTTCAACC |
| | | | GGGGCGAGTGT |
| 192 | Human IgG4 heavy chain constant region #1 | IGHG4*01 & IGHG4*04 Heavy Chain Constant Region Nucleotide Sequence | gcttccaccaaggggccatccgtcttccccctggcgccctgctccaggagcacctccgagagcacagccg<br>ccctggctgcctggtcaaggactactcccccgaaccggtgacggtgtcgtggaactcaggcgccctgac<br>cagcggcgtgcacaccttcccggctgtcctacagtcctcagactctactcccctcagcagcgtgtgaccg<br>tgccctccagcagcttgggcacgaagaccatacacctgcaacgtagatcacaagcccagcaacaccaagg<br>tggacaagagagttgagtccaaatatggtcccccatgcccaccatgcccagcacctgagttcctgggggg<br>accatcagtcttcctcttcccccaaaacccaaggacactctcatgatctcccggaccccgaggtcacgtg<br>cgtggtggtgacgtgagccaaagaccgtgaggtccaggaagccaaggtacaagtgcaagtccgaggtggagg<br>tgcataatgccaagacaaagccgcgggaggagcagttcaacagcacgtaccgtgtggtcagcgtcctca<br>ccgtcctgcaccaggactggctgaacggcaaggagtacaagtgcaaggtctccaacaaaggcctcccgt<br>cctccatcgagaaaaccatctccaaagccaaaggcagcccgagaaccacaggtgtacaccctgcccc<br>catcccgggaggagatgaccaagaaccaggtcagcctgacctgcctggtcaaaggcttctaccccagcg<br>acatcgccgtggagtgggagagcaatgggcagccggagaacaactacaagaccacgcctcccgtgctg<br>gactctgacggctctcttcttcctctacagcaggctcaccgtggacaagagcaggtggcaggggaat<br>gtcttctcatgctccgtgatgcatgaggctctgcacaaccactacacgcagaagagcctctccctgtctctg<br>ggtaaa |
| 193 | | Heavy Chain Constant Region Amino Acid Sequence | ASTKGPSVFPLAPCSRSTSESTAALGCLVKDYFPEPVTVSWNSGALTSGVHTFPAVL<br>QSSGLYSLSSVVTVPSSSLGTKTYTCNVDHKPSNTKVDKRVESKYGPPCPSCPAPEF<br>LGGPSVFLFPPKPKDTLMISRTPEVTCVVVDVSQEDPEVQFNWYVDGVEVHNAKTK<br>PREEQFNSTYRVVSVLTVLHQDWLNGKEYKCKVSNKGLPSSIEKTISKAKGQPREP<br>QVYTLPPSQEEMTKNQVSLTCLVKGFYPSDIAVEWESNGQPENNYKTTPPVLDSD<br>GSFFLYSRLTVDKSRWQEGNVFSCSVMHEALHNHYTQKSLSLSLGK |
| 194 | Human IgG4 heavy chain constant region #2 | IGHG4*02 Heavy Chain Constant Region Nucleotide Sequence | gcttccaccaaggggccatccgtcttccccctggcgccctgctccaggagcacctccgagagcacagccg<br>ccctggctgcctggtcaaggactactcccccgaaccggtgacggtgtcgtggaactcaggcgccctgac<br>cagcggcgtgcacaccttcccggctgtcctacagtcctcagactctactcccctcagcagcgtgtgaccg<br>tgccctccagcagcttgggcacgaagaccatacacctgcaacgtagatcacaagcccagcaacaccaagg<br>tggacaagagagttgagtccaaatatggtcccccatgcccaccatgcccagcacctgagttcctgggggg<br>accatcagtcttcctcttcccccaaaacccaaggacactctcatgatctcccggaccccgaggtcacgtg<br>cgtggtggtgacgtgagccaaagaccgtgaggtccaggaagccaaggtacaagtgcaagtccgaggtggagg<br>tgcataatgccaagacaaagccgcgggaggagcagttcaacagcacgtaccgtgtggtcagcgtcctca<br>ccgtcctgcaccaggactggctgaacggcaaggagtacaagtgcaaggtctccaacaaaggcctcccgt<br>cctccatcgagaaaaccatctccaaagccaaaggcagccccgagaaccacaggtgtacaccctgcccc<br>catcccgggaggagatgaccaagaaccaggtcagcctgacctgcctggtcaaaggcttctaccccagct<br>gacactccgacggctctcttcttcctctacagcaacactacacgcagaagagccggcaggggga<br>atgtcttctcatgctccgtgatgcatgaggctctgcacaaccactacacgcagaagagcctctccctgtctc<br>tgggtaaa |

| SEQ ID NO: | Name | Description | Sequence |
|---|---|---|---|
| 195 | | Heavy Chain Constant Region Amino Acid Sequence | ASTKGPSVFPLAPCSRSTSESTAALGCLVKDYFPEPVTVSWNSGALTSGVHTFPAVL QSSGLYSLSSVVTVPSSSLGTKTYTCNVDHKPSNTKVDKRVESKYGPPCPSCPAPEF LGGPSVFLFPPKPKDTLMISRTPEVTCVVVDVSQEDPEVQFNWYVDGVEVHNAKTK PREEQFNSTYRMVSLTVVHQDWLNGKEYKCKVSNKGLPSSIEKTISKAKGQPREP QVYTLPPSQEEMTKNQVSLTCLVKGFYPSDIAVEWESNGQPENNYKTTPPVLDSD GSFFLYSRLTVDKSRWQEGNVFSCSVMHEALHNHYTQKSLSLSLGK |
| 196 | Human IgG4 heavy chain constant region #3 IGHG4*03 | Heavy Chain Constant Region Nucleotide Sequence | gcttccaccaagggcccatccgtcttccccctggcgccctgctctcaggagcacagccg cctggctgcctggtcaaggactactcccgaaccggtgacggtgtcgtggaactcaggcgctgac cagcggcgtgcacaccttcccggctgtcctacagtctcctcaggactctactccctcagcagcgtggtgaccg tgccctccagcagcttgggcacgaagaccctacaccgtcaacgtagatcacaaagcccagcaaccaagg tggacaagagagttgagtccaaatatggtccccccgtgcccatgcccagcccagagcccagagcccagagcccagcc accactcagctcttcctgttccccccaaaacccaaggacaccctcatgatctccccggaccccgctgaggtcacgtg cgtggtggtggacgtgagccacgaagaccccgaggtccagttcaactggtacgtggatggcgtggag tgcataatgccaagacaaagccgcggggaggagcagttcaacagcacgtaccgtgtggtcagcgtcctca ccgtcctgcaccaggactggctgaacggcaaggagtacaagtgcaaggtctccaacaaaggcctccccgt catccagaaaccatctccaaagccaaagggcagccccgagaaccaggtcagcctgacctgcctggtcaaaggcttctaccccgcg acatcgcggtggagtggagagcaatgggcagccggagaacaactacaagaccacgcctcccgtgctg gactgtgactccgactctctatcgcctccgtgatgcatgaggctctgcacaaccactaccagaagagcctcccccgtctctg gtaaa |
| 197 | | Heavy Chain Constant Region Amino Acid Sequence | ASTKGPSVFPLAPCSRSTSESTAALGCLVKDYFPEPVTVSWNSGALTSGVHTFPAVL QSSGLYSLSSVVTVPSSSLGTKTYTCNVDHKPSNIKVDKRVESKYGPPCPSCPAPEF LGGPSVFLFPPKPKDTLMISRTPEVTCVVVDVSQEDPEVQFNWYVDGVEVHNAKTK PREEQFNSTYRVVSVLTVLHQDWLNGKEYKCKVSNKGLPSSIEKTISKAKGQPREP QVYTLPPSQEEMTKNQVSLTCLVKGFYPSDIAVEWESNGQPENNYKTTPPVLDSD GSFFLYSKLTVDKSRWQEGNVFSCSVMHEALHNHYTQKSLSLSLGK |
| 198 | IgG4 heavy chain constant region-IgG4-PE IGHG4-PE | Heavy Chain Constant Region Nucleotide Sequence-Synthetic Version A | gcttccaccaagggcccatccgtcttccccctggcgccctgctctcaggagcacagccg cctggctgcctggtcaaggactactcccgaaccagtgacggtgtcgtggaactcaggcgctgac cagcggcgtgcacaccttcccggctgtcctacagtctcctcaggactctactccctcagcagcgtggtgaccg tgccctccagcagcttgggcacgaagaccctacaccgtcaacgtagatcacaaagcccagcaaccaagg tggacaagagagttgagtccaaatatggtccccccgtgcccatgcccagcccgcctgaattgagggg gaccatgatcttcctgttcccccaaaacccaaggacactctcatgatctccccggaccccgctgaggtcacgt ggtggtggtggacgtgagccagaacaagccgcgggaggagcagttcaacagcacgtaccgtgtggtcagcgtcctc accgtcctgcaccaggactggctgaacggcaaggagtacaagtgcaaggtctccaacaaaggcctcc ccatccagaaaaccatctccaaagccaaagggcagccccgagagccaggtcagcctgacctgcctggtcaaaggcttctaccccca gcgacatcgcggtggagtgggagagcaatggccagccggagaacaactacaagaccacgcctcccgt gctggactccgacggcctcttcatgcctcgtgatgcatgaggctctgcacaaccactaccagaagagcctctccctctc aatgcttcctcatgctccgtgatgcatgaggctctgcacaaccactaccagaagagcctctccctgtc tctgggtaaa |

| SEQ ID NO: | Name | Description | Sequence |
|---|---|---|---|
| 199 | IgG4 heavy chain constant region-IgG4-PE | Heavy Chain Constant Region Amino Acid Sequence-Encoded by Synthetic Version A, B & C (Two residues that differ from the wild-type sequence are identified in bold) | ASTKGPSVFPLAPCSRSTSESTAALGCLVKDYFPEPVTVSWNSGALTSGVHTFPAVL QSSGLYSLSSVVTVPSSSLGTKTYTCNVDHKPSNTKVDKRVESKYGPPCPAPEF EGGPSVFLFPPKPKDTLMISRTPEVTCVVVDVSQEDPEVQFNWYVDGVEVHNAKT KPREEQFNSTYRVVSVLTVLHQDWLNGKEYKCKVSNKGLPSSIEKTISKAKGQPRE PQVYTLPPSQEEMTKNQVSLTCLVKGFYPSDIAVEWESNGQPENNYKTTPVLDSD GSFFLYSRLTVDKSRWQEGNVFSCSVMHEALHNHYTQKSLSLSLGK |
| 200 | IgG4 heavy chain constant region-IgG4-PE | Heavy Chain Constant Region Nucleotide Sequence-Synthetic Version B | Gcctccaccaagggaccctagcgtgttccctctcgccctgtgctccaggagtccaccgctgc cctcggctgtctggtgaaagactacttccgagccgtgacctctccgagtagcgagcctgacct ccggctgcacacattccgacgtgtgctgagcagcgacgtatagcctgagcagcgtggtgaccgt gccagtccagctctggcaccgtcgaactgcaaccctcgcaacaccaaggt ggacaagcgggtggagctgcaagttacggccccccctgcctcctgtctgccccgagttcgaggagg acccctcgctgctctgtttccccccaaacccaaggacaccctgatgatctccgagaccccgggagtgacct gtgtggtcgtggacgtgagccagagggacccgaggtgcagttcaattcaactggactaggagatgggctggaga gtgcaatgcccaaacaaccaggagggagcagttcaagctacaagccgaggaggccccagtgtacaaggactgc cagtcctgtgcatgagaaccatcagcaaggcaaggggccaggtcgaaatgcgggaggacgctgaccct cctcctagacgccgtgagtgggggaagaatgaccaagttccctgaccgctggtgaagggattctacccct cgacatgccgtggactggagctcttcttctacagcgcggctgcacatcaaccggagctgacaagagcaggtgcaggaggc ctgatagccgacggagagttcctgtccgtgatgcacgaggccctgcaccataccagagagccctccctgtcc ctgggcaagg |
| 201 | IgG4 heavy chain constant region-IgG4-PE | Heavy Chain Constant Region Nucleotide Sequence-Synthetic Version C | gccagcaccaagggcccttccgtgttcccctggcccctgtgcagcaggagcacctccgaatccagctg cctggctgtctggtgaaggactacttccgagccgtgacctgagctggaacagcggcctgac atccggcgtccacaccttcctgcccgtccagtctccggcctgagctcctccgagtagtgctccgtgaccgtg cctaggtcctccctccggcaccaagacctacacctgcaacgtggaccacaaccctccaacaccaaggtgg acaaacgggtcgagagcaaagtacggccctccgcctgcccagccagagaccctcgtctcctgtccgagttcgaaggcggacc cagcgtgttcctgttcccccagaaacccaaggacaccctgatgatcagcgacccgagttgagcctgacctgc gtgtggtgctgatgtgcagaccgaggacctgacgtccagtcagctgtagacggtggtgatggtgggagtg cacaacgcaaggacaaccccggaagccagtgctcaactccacaagtggcagcgtcgtgac cgtgctgcatcgaggactgctgaacggcaagggctaaggccaggccctgagcctgagttcctcctgaccctgcctc ggagatggggaggagatgacccagaacccaagcctggagctccgtggaaggattctcacccttccg acatccggccggtggatgctgaacgccgtggacaatatataagaccacccctccgtcctcg acagcgacggtatctcctcttctgctgacgaggcctgcacatcactcacaccagagctggataagtccagtggcaaagaagcacgt gtcagctgctgccgtgctgctgatgcacgaggcctgcacctctgatctccggaccctgagccttgtcctgg gaaag |
| 202 | IgG4 heavy chain constant region-inactivated | Heavy Chain Constant Region Nucleotide Sequence | gcctccaccaagggcccatccgtcttcccctgcccctgctccaggagcacctccgagagcacggccg cctggctgcctggtgaaagactacttccgacctggtcaaggactactccgagccgtgacggtgtcgtggaactcaggcgccctgac cagcccctcaacgccaagttgggcacgctcagcttcctctgcctgccagcccggactccttcccctccgtccgtatccgtgtcctccagcaacccgtggtgaccgtg tgccctccagcactctgggacacccagaactcacctgcacgtagatcacaaagcccagcaacaccaaggg tggacaagagagttgagtccaaatatggtccccaaaaccagagaccctctgccccaccgcctccagttgcggggg gaccatcagtctcctgttccccaaaacccaaggacactctcatgatctccggacctggatggcgtggtg gttgtgtggtgcggaaccgacgaggaaccagccctgagctccgtgcagcgccgtcgtaaggtctccgagtgcacgtaag gtgcataatgccaagacaaagccgcgggaggaggcagttcaacagcacgtaccgtgtgtcagtcctc |

| SEQ ID NO: | Name | Description | Sequence |
|---|---|---|---|
| | | | accgtcctgcaccaggactgctgaacgcgcaaggagtacaagtgcaaggtgtacaagtgcaaggtctccaacaaaggcctccc<br>gtcatcgatcgagaaaacactctccaaagccaccaaaggtcagccccgagagtgcagcaaggtgtacaccctgc<br>cccatcccaggaggagatgaccaagaaccaggtcagccgagcagccgtgcctgtcaaagttctacccca<br>gcgacatcgccgtggagtgggagaacaatggcagccgaggaacaactacaagaccacgcctccgt<br>gctggactccgacggatcctttctcctctacagcaggctcaccctggacaagagcaggtggcaggagg<br>gaatgcttcatgctcgacgatgaggctctgcacaacactacacagaagacctccctgtc<br>tctgggtaaa |
| 203 | Disabled Human IgG1 heavy chain constant region | Heavy Chain Constant Region Amino Acid Sequence (inactivating mutations from human WT IgG4 shown in bold) | ASTKGPSVFPLAPCSRSTSESTAALGCLVKDYFPEPVTVSWNSGALTSGVHTFPAVL<br>QSSGLYSLSSVVTVPSSSLGTKTYTCNVDHKPSNTKVDKRVESKYGPPCPPCPAPP<br>VAGGPSVFLFPPKPKDTLMISRTPEVTCVVVDVSQEDPEVQFNWYVDGVEVHNAK<br>TKPREEQFNSTYRWSVLTVLHQDWLNGKEYKCKVSNKGLPSSIEKTISKAKGQPR<br>EPQVYTLPPSQEEMTKNQVSLTCLVKGFYPSDIAVEWESNGQPENNYKTTPPVLDS<br>DGSFFLYSRLTVDKSRWQEGNVFSCSVMHEALHNHYTQKSLSLSLGK |
| 204 | | Heavy Chain Constant Region Nucleotide Sequence | gcctccaccaagggcccatcggtcttccccctggcaccctcctccaagagcacctctgggggacacagcgg<br>ccctgggctgcctggtcaaggactacttccccgaaccggtgacggtgtcgtggaactcaggcgccctgac<br>cagcggcgtgcacaccttcccggctgtcctacagtcctcaggactctactccctcagcagcgtggtgaccg<br>tgccctccagcagcttgggcacccagacctacatctgcaacgtgaatcacaagcccagcaacaccaagg<br>tggacaagaaagttgagcccaaatcttgtgacaaaactcacacatgcccaccgtgcccagcacctgaac<br>tcctggggggaccgtcagtcttcctcttccccccaaaacccaaggacaccctcatgatctcccggacccct<br>gaggtcacatgcgtggtggtggacgtgagccacgaagaccctgaggtcaagttcaactggtacgtggac<br>ggcgtggaggtgcataatgccaagacaaagccgcgggaggagcagtacaacagcacgtaccgtgtgg<br>tcagtgtcctcaccgtcctgcaccaggactggctgaatggcaaggagtacaagtgcaaggtctccaaca<br>aagccctcccagcccccatcgagaaaaccatctccaaagccaaaggcagccccgagaaccacaggtg<br>tacaccctgcccccatcccgggatgagctgaccaagaaccaggtcagcctgacctgcctggtcaaagct<br>tctatcccagcgacatcgccgtggagtgggagagcaatgggcagccggagaacaactacaagaccac<br>gcctcccgtgctggactccgacggctccttcttcctctatagcaagctcaccgtggacaagagcaggtggc<br>agcaggggaacgtcttctcatgctccgtgatgcatgaggctctgcacaaccactacacgcagaagagcct<br>ctccctgtctccgggtaaa |
| 205 | | Heavy Chain Constant Region Amino Acid Sequence (Two residues that differ from the wild-type sequence are identified in bold) | ASTKGPSVFPLAPSSKSTSGGTAALGCLVKDYFPEPVTVSWNSGALTSGVHTFPAVL<br>QSSGLYSLSSVVTVPSSSLGTQTYICNVNHKPSNTKVDKKVEPKSCDKTHTCPPCP<br>APELAGAPSVFLFPPKPKDTLMISRTPEVTCVVVDVSHEDPEVKFNWYVDGVEVHN<br>AKTKPREEQYNSTYRWSVLTVLHQDWLNGKEYKCKVSNKALPAPIEKTISKAKGQ<br>PREPQVYTLPPSRDELTKNQVSLTCLVKGFYPSDIAVEWESNGQPENNYKTTPPVL<br>DSDGSFFLYSKLTVDKSRWQQGNVFSCSVMHEALHNHYTQKSLSLSPGK |
| 206 | Human Cκ constant region | Cκ Light Chain Constant Region Nucleotide Sequence | cgtacgtggctgcctccctccgtgtcatcttccacctccgacgagcagcagctgaagtccggcaccgcttct<br>gtcgtgtgcctgctgaacaacttctacccccgaggccaaggtgcagtggaaggtggacaacgccctg<br>cagtccggcaactccccaggaatccgtgaccgagcaggactccaaggacagcacctactcctgtctcca<br>ccctgaccctgtccaaggcgactacgagaagcacaaggtgtacgcctgcgaagtgacccaccagggc<br>ctgttagcccgtcgaccaagtcttcaaccgggcgagtgt |

| SEQ ID NO: | Name | Description | Sequence |
|---|---|---|---|
| 207 | Human Cκ constant region | Cκ Light Chain Constant Region Amino Acid Sequence | RTVAAPSVFIFPPSDEQLKSGTASVVCLLNNFYPREAKVQWKVDNALQSGNSQESV TEQDSKDSTYSLSSTLTLSKADYEKHKVYACEVTHQGLSSPVTKSFNRGEC |
| 208 | Human Cκ constant region IGKC*02 | Cκ Light Chain Constant Region Nucleotide Sequence | cgaactgtggctgcaccatctgtcttcatcttcccgccatctgatgagcagttgaaatctggaactgcctctg ttgtgtgcctgctgaataacttctatcccagagaggccaaagtacagtggaaggtgataacgccctcca atcgggtaactcccaggagagtgtcacagagcaggacaagcgggacagcacctacagcctcagcagc accctgacgctgagcaaagcagactacgagaaacacaaagtctacgcctgcgaagtcacccatcagc cctgagctcgccccgtcacaaagagcttcaacaggggagagtgt |
| 209 | Human Cκ constant region | Cκ Light Chain Constant Region Amino Acid Sequence | RTVAAPSVFIFPPSDEQLKSGTASVVCLLNNFYPREAKVQWINDNALQSGNSQESV TEQESKDSTYSLSSTLTLSKADYEKHKVYAGEVTHQGLSSPVTKSFNRGEC |
| 210 | Human Cκ constant region IGKC*03 | Cκ Light Chain Constant Region Nucleotide Sequence | cgaactgtggctgcaccatctgtcttcatcttcccgccatctgatgagcagttgaaatctggaactgcctctg ttgtgtgcctgctgaataacttctatcccagagaggccaaagtacagcggaaggtggataacgcctcagc atcggtaactcccaggagagtgtcacagagcaggacaagcaaggacagcacctacagcctcagcagc accctgacgctgagcaaagcagactacgagaaacacaaatctacgcctgcgaagtcacccatcaggg cctgagctcgccccgtcacaaagagcttcaacaggggagagtgt |
| 211 | Human Cκ constant region | Cκ Light Chain Constant Region Amino Acid Sequence | RTVAAPSVFIFPPSDEQLKSGTASVVCENNFYPREAWQRKVDNALQSGNSQESV TEQESKDSTYSLSSTLTLSKADYEKHKVYACEVTHQGLSSPVIKSFNRGEC |
| 212 | Human Cκ constant region IGKC*04 | Cκ Light Chain Constant Region Nucleotide Sequence | cgaactgtggctgcaccatctgtcttcatcttcccgccatctgatgagcagttgaaatctggaactgcctctg ttgtgtgcctgctgaataacttctatcccagagaggccaaagtacagtggaaggtgataacgcccctcagc atcgggtaactcccaggagtgtcacagagcaggacaagcagcacctacagcctcagcagc accctgagcaaacagcagcagcaaaagctacgagaaacaccctacgcctgcgaagtcacccatcaggg cctgagctcgccccgtcacaaagagcttcaacaggggagagtgc |
| 213 | Human Cκ constant region | Cκ Light Chain Constant Region Amino Acid Sequence | RTVAAPSVFIFPPSDEQLKSGTASVVCLLNNFYPREAKVQWKVDNALQSGNSQESV TEQDSKDSTYSLSSTLJTLSKADYEKHKLYACEVTHQGLSSPVTKSFNRGEC |
| 214 | Human Cκ constant region IGKC*05 | Cκ Light Chain Constant Region Nucleotide Sequence | cgaactgtggctgcaccatctgtcttcatcttcccgccatctgatgagcagttgaaatctggaactgcctctg ttgtgtgcctgctgaataacttctatcccagagaggccaaagtacagtggaaggtgataacgccctcca atcgggtaactcccaggagtgtcacagagcaggacaagcaaggacagcacctacagcctcagcaac accctgagctcgccagagcaaaagctacgcctgcgaagtcacccatcaggg cctgagctcgccccgtcacaaagagcttcaacaggggagagtgc |
| 215 | Human Cκ constant region | Cκ Light Chain Constant Region Amino Acid Sequence | RTVAAPSVFIFPPSDEQLKSGTASVVCLLNNFYPREAKVQWKVDNALQSGNSQESV TEQDSKDSTYSLSNTLJTLSKADYEKHKVYACEVTHQGLSSPVTKSFNRGEC |
| 216 | Human Cλ constant region IGLC1*01 | Cλ Light Chain Constant Region Nucleotide Sequence | cccaaggccaaccccacggtcactctgttcgacccgcccctcctggagagcctcaaggcaacaaggccacac tagtgtgtctgatcagtgacttctaccgggagtcgacagtgtgaaggcttgaaggcagcagcccgt caagcgggacgggagcgacgacaacccctccaaacagagcaacaacaagtacgccgcagcagcta ccgtgagcaagcacagtggagcagtcgccaagctgcagtctacagctcgccccagtcacaggtcacggcagtgaagggga gcaccgtggagaagacagtgcccctcacagagatgttca |
| 217 | Human Cλ constant region | Cλ Light Chain Constant Region Amino Acid Sequence | PKANPTVTLFPPSSEELQANKATLVCLISDFYPGAVTVAWKADGSPVKAGVETTKPS KQSNNKYAASSYLSLTPEQWKSHRSYSCQVTHEGSTVEKTVAPTECS |

| SEQ ID NO: | Name | Description | Sequence |
|---|---|---|---|
| 218 | Human Cλ constant region | Cλ Light Chain Constant Region IGLC1*02 Nucleotide Sequence-version A | ggtcagcccaaggccaacccactgtcactctgttccgccctcctcctgaggagtccaacaagg ccaactagtgtctgatcagtgacttctaccgggagcctgacagtgccttgaaggcagatggcag ccccgtcaaggccgggagtggagacccgagcagtggaagctccaaacagcaacaacagtgccagc agctacctgagcctgacgccctgagtgaagacacagtgccctgcaagtacgcggtacacgcatga aggagcaccctggagaagacagtgccctacagaatgttca |
| 219 | | Cλ Light Chain Constant Region Amino Acid Sequence-encoded by version A or B | GQPKANPTVTLFPPSSEELQANKATLVCLISDFYPGAVTVAWKADGSPVKAGVETT KPSKQSNNKYAASSYLSLTPEQWKSHRSYSCQVTHEGSTVEKTVAPTECS |
| 220 | | Cλ Light Chain Constant Region IGLC1*02 Nucleotide Sequence-Version B | ggtcagcccaaggccaaccccactgtcactctgttccgccctcctcctgaggagtccaacaagg ccaactagtgtctgatcagtgacttctaccgggagcctgacagtgccttgaaggcagatggcag ccccgtcaaggccgggagtggagacccgagcagtggaagctccaaacagcaacaacagtgccagc agctacctgagcctgacgccctgagtgaagacacagtgccctgcaagtacgcggtacacgcatga aggagcaccctggagaagacagtgccctacagaatgttca |
| 221 | Human Cλ constant region | Cλ Light Chain Constant Region IGLC2*01 Nucleotide Sequence-Version A | ggcagcctaaggccctctcctctgtgaccctgttcccccatccctgaggaactgcaggctcaacaagc cacctcgtgtctgcctgatcagcgattctgacagtccgtgctgaaggcctgaagtgatagctctc ctgtccaaggccggctggaaaccaccactcctcaagcagtccaactgctccaagctgccaagtgaccacgagctcca acgtgaaagaaccgtgcctgcctctaccgagtgctcc |
| 222 | | Cλ Light Chain Constant Region IGLC2*01 Nucleotide Sequence-Version B | ggccagcctcaaagctgccccaagcgtcactctgttcctcctcagcgaagctcaccgtcccaaggg caaccctcgtgtctgcctgatctccgacttctcgacctgtgaccgtggcttggaaagctacgcgcctccagct ctgtcaaggccactggaatccccaccactcctcaccactcaaccgtcctcaaagtacgccgcctccagct atctccctcgacccctgagcagtgaagtcccacctgtcctactcctgtggtgcccccgcgagggctcc accgtgaaaagaccgtgcccaccacccagtgctcc |
| 223 | | Cλ Light Chain Constant Region Amino Acid Sequence-Encoded by Version A or B | GQPKANPTVTLFPPSSEELQANKATLVCLISDFYPGAVTVAWKADGSPVKAGVETT KPSKQSNNKYAASSYLSLTPEQWKSHRSYSCQVTHEGSTVEKTVAPTECS |
| 224 | Human Cλ constant region | Cλ Light Chain Constant Region IGLC2*02 & IGLC2*03 Nucleotide Sequence | ggtcagcccaaggctgcccctcggtcactctgttccgccctcctcctgaggagtccaacaaggc cacactggtgtctcataagtgacttctaccggagcgtgacagttgcctgaaggcagagatagcag ccccggcaaggcgggagtgggacctgagcagtggaagctccacacaaaagcaacaacaagcgcccagc agctatctgagcctgacgcctgagcgcactgacgcctgacacctgagagtgcccctacgaatgttgaa gggagcaccctggagaagacagtgccctacagaatgttca |
| 225 | | Cλ Light Chain Constant Region Amino Acid Sequence | GQPKAAPSVTLFPPSSEELQANKATLVCLISDFYPGAVTVAWKADSSPVKAGVETTT PSKQSNNKYAASSYLSLTPEQWKSHRSYSCQVTHEGSTVEKTVAPTECS |
| 226 | Human Cλ constant region | Cλ Light Chain Constant Region IGLC3*01 Nucleotide Sequence | cccaaggctgccccctcggtcactcttgttccacccctctgaggagttcaagccaacaaggccacact ggtgtgtctcataagtgacttctaccggagccgtgacagttcctgaaggcagatagcagcccgtc aaggcgggggtgaaagtggagacacaagcaacaacaaaagctacgcccagcgctacc tgacctgagcctgacgcagtgaagtcccaaaaagctcacgctccagtgccactgaaggagc accgtgagaaggaacagtgtgcccctacggaatgttca |

SEQUENCE LISTING

| SEQ ID NO: | Name | Description | Sequence |
|---|---|---|---|
| 227 | Human Cλ constant region | Cλ Light Chain Constant Region Amino Acid Sequence | PKAAPSVTLFPPSSEELQANKATLVCLISDFYPGAVTVAWKADSSPVKAGVETTTPS KQSNNKYAASSYLSLTPEQWKSHKSYSCQVTHEGSTVEKTVAPTECS |
| 228 | Human Cλ constant region | IGLC3*02 Cλ Light Chain Constant Region Nucleotide Sequence | ggtcagcccaaggctgcccccctcggtcactctgttcccaccctcctgaggagcttcaagccaacaaggc cacactggtgtgtctcataagtgacttctaccgggacgtgaccagttgcctgaagtcagcagatagcag ccgtcaaggcgggggtggagaccaacaccacacccctcaaacaaagcaacaacaagtacgcggcagca gctacctgagcctgacgcctgagcagtggaagtccacagagtgccctacggaatgttca gagcacctgagaagacagtggccctacggaatgttca GQPKAAPSVTLFPPSSEELQANKATLVCLISDFYPGPVTVAWKADSSPVKAGVETTT PSKQSNNKYAASSYLSLTPEQWKSHKSYSCQVTHEGSTVEKTVAPTECS |
| 229 | Human Cλ constant region | Cλ Light Chain Constant Region Amino Acid Sequence | GQPKAAPSVTLFPPSSEELQANKATLVCLISDFYPGPVTVAWKADSSPVKAGVETTT PSKQSNNKYAASSYLSLTPEQWKSHKSYSCQVTHEGSTVEKTVAPTECS |
| 230 | Human Cλ constant region | IGLC3*03 Cλ Light Chain Constant Region Nucleotide Sequence | ggtcagcccaaggctgcccccctcggtcactctgttcccaccctcctgaggagcttcaagccaacaaggc cacactggtgtgtctcataagtgacttctaccgggagcgtgaccagtggcctgaaggcagatagcag ccgtcaaggcgggggtggagaccaacaccacacccctcaaacaaagcaacaacaagtacgcggccagc agctacctgagcctgacgcctgagcagtggaagtccacagagtgccctacggaatgttca gggacacctgagaacagtggccctacggaatgttca GQPKAAPSVTLFPPSSEELQANKATLVCLISDFYPGAVTVAWKADSSPVKAGVETTT PSKQSNNKYAASSYLSLTPEQWKSHKSYSCQVTHEGSTVEKTVAPTECS |
| 231 | Human Cλ constant region | Cλ Light Chain Constant Region Amino Acid Sequence | GQPKAAPSVTLFPPSSEELQANKATLVCLISDFYPGAVTVAWKADSSPVKAGVETTT PSKQSNNKYAASSYLSLTPEQWKSHKSYSCQVTHEGSTVEKTVAPTECS |
| 232 | Human Cλ constant region | IGLC3*04 Cλ Light Chain Constant Region Nucleotide Sequence | ggtcagcccaaggctgcccccctcggtcactctgttccgccctcctgaggagcttcaagccaacaaggc cacactggtgtgtctcataagtgacttctaccgggagcgtgaccagtggcctgaaggcagatagcag ccgtcaaggcgggggtggagaccaacaccacacccctcaaacaaagcaacaacaagtacgcggccagc agctacctgagcctgacgcctgagcagtggaagtccacagaaagctacagtgccaggtcacgcgccagc gggacacctgagaacagtggccctacggaatgttca GQPKAAPSVTLFPPSSEELQANKATLVCLISDFYPGAVTVAWKADSSPVKAGVETTT PSKQSNNKYAASSYLSLTPEQWKSHRSYSCQVTHEGSTVEKTVAPTECS |
| 233 | Human Cλ constant region | Cλ Light Chain Constant Region Amino Acid Sequence | GQPKAAPSVTLFPPSSEELQANKATLVCLISDFYPGAVTVAWKADSSPVKAGVETTT PSKQSNNKYAASSYLSLTPEQWKSHRSYSCQVTHEGSTVEKTVAPTECS |
| 234 | Human Cλ constant region | IGLC6*01 Cλ Light Chain Constant Region Nucleotide Sequence | ggtcagcccaaggctgcccatcgtcactctgttccgccctcctgttcctgaggagcttcaagccaacaaggc cacactggtgcctgatcagtgacttctaccgggagcgtgaaagtggcctgaaagcagatgaggcagc cccgtcaacacggagtggagaccaacaccacacctccaaacagagcaacaacaagtacgccgcagcc agctacctgagcctgacgcctgagcagtggaagtccacagaaagctacagtgccaggtcacgcgccagc gggacacctgagaacagtggccctacgcagaatgttca GQPKAAPSVTLFPPSSEELQANKATLVCLISDFYPGAVKVAWKADGSPVNTGVETT TPSKQSNNKYAASSYLSLTPEQWKSHRSYSCQVTHEGSTVEKTVAPAECS |
| 235 | Human Cλ constant region | Cλ Light Chain Constant Region Amino Acid Sequence | GQPKAAPSVTLFPPSSEELQANKATLVCLISDFYPGAVKVAWKADGSPVNTGVETT TPSKQSNNKYAASSYLSLTPEQWKSHRSYSCQVTHEGSTVEKTVAPAECS |
| 236 | Human Cλ constant region | IGLC7*01 & IGLC7*02 Cλ Light Chain Constant Region Nucleotide Sequence | ggtcagcccaaggctgcccatcgtcctcgtaagtgacttctaccctcctgaggagcttcaagccaacaaggc cacactggtgtctcgtaagtggagaccgtgaccagtggcctgaaggcagatggccagc cccgtcaaggtgggagtggagaccaacaccacaaacagcaacaacaagtatgccgcagc agctacctgagcctgacgcctgagcagtggaagtccacagaaagctacagtgcccggtcacgcgccagc agggacacctggagaagacagtgccccctcgcagaatgctct GQPKAAPSVTLFPPSSEELQANKATLVCLVSDFYPGAVTVAWKADGSPVIWGVETT KPSKQSNNKYAASSYLSLTPEQWKSHRSYSCRVTHEGSTVEKTVAPAECS |
| 237 | Human Cλ constant region | Cλ Light Chain Constant Region Amino Acid Sequence | GQPKAAPSVTLFPPSSEELQANKATLVCLVSDFYPGAVTVAWKADGSPVIWGVETT KPSKQSNNKYAASSYLSLTPEQWKSHRSYSCRVTHEGSTVEKTVAPAECS |
| 238 | 413G05-CDRH1 (IMGT) | Amino acid sequence of CDRH1 of 413G05 using IMGT | GFTFSDYY |

| SEQ ID NO: | Name | Description | Sequence |
|---|---|---|---|
| 239 | 413G05-CDRH2 (IMGT) | Amino acid sequence of CDRH2 of 413G05 using IMGT | ISTSGSTI |
| 240 | 413G05-CDRH3 (IMGT) | Amino acid sequence of CDRH3 of 413G05 using IMGT | ARGITGINFYHYGLGV |
| 241 | 413G05-CDRH1 (Kabat) | Amino acid sequence of CDRH1 of 413G05 using Kabat | DYYMS |
| 242 | 413G05-CDRH2 (Kabat) | Amino acid sequence of CDRH2 of 413G05 using Kabat | YISTSGSTIYYADSVKG |
| 243 | 413G05-CDRH3 (Kabat) | Amino acid sequence of CDRH3 of 413G05 using Kabat | GITGTNFYHYGLGV |
| 244 | 413G05-Heavy chain variable region | Amino acid sequence of $V_H$ of 413G05 | QVQLVESGGGLVKPGGSLRLSCAASGFTFSDYYMSWIRQVPGKGLEWVSYISTSG STIYYADSVKGRFTISRDNAKNSLYLQMNSLRAEDAAVYHCARGITGTNFYHYGLG VWGQGTTVTVSS |
| 245 | 413G05-Heavy chain variable region | Nucleic acid sequence of $V_H$ of 413G05 | CAGGTGCAGCTGGTGGAGTCTGGGGGAGGCTTGGTCAAGCCTGGAGGGTCCCT GAGACTCTCCTGTGCAGCCTCTGGATTCACCTTCAGTGACTACATGAGCTG GATCCGCCAGGTTCCAGGGAAGGGGCTGGAGTGGGTTTCATATACATTAGTACTAG TGGTAGTACCATATACTACGCAGACTCTGTGAAGGGCCGATTCACCATCTCCAG GGACAACGCCAAGAACTCACTGTATCTACAAATGAACAGCTGAGAGCCGAGGA CGCGGCCGTGTATCACTGTGCGAGAGGTATAACTGGAACTAACTTCTACCACTA CGGTTTGGGCGTCTGGGGCCAAGGGACCACGGTCACCGTCTCCTCAG |
| 246 | 413G05-full heavy chain sequence | Amino acid sequence of 413G05 heavy chain | QVQLVESGGGLVKPGGSLRLSCAASGFTFSDYYMSWIRQVPGKGLEWVSYISTSG STIYYADSVKGRFTISRDNAKNSLYLQMNSLRAEDAAVYHCARGITGTNFYHYGLG VWGQGTTVWSSASTKGPSVFPLAPSSKSTSGGTAALGCLVKDYFPEPVTVSWNS GALTSGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHEDPEVK FNWYVDGVEVHNAKTKPREEQYNSTYRWSVLTVLHQDWLNGKEYKCKVSNKALP APIEKTISKAKGQPREPQVYTLPPSRDELTKNQVSLTCLVKGFYPSDIAVEWESNGQ PENNYKTTPPVLDSDGSFFLYSKLTVDKSRWQQGNVFSCSVMHEALHNHYTQKSL SLSPGK |
| 247 | 413G05-full heavy chain sequence | Nucleic acid sequence of 413G05 heavy chain | CAGGTGCAGCTGGTGGAGTCTGGGGGAGGCTTGGTCAAGCCTGGAGGGTCCCT GAGACTCTCCTGTGCAGCCTCTGGATTCACCTTCAGTGACTACATGAGCTG GATCCGCCAGGTTCCAGGGAAGGGGCTGGAGTGGGTTTCATATACATTAGTACTAG TGGTAGTACCATATACTACGCAGACTCTGTGAAGGGCCGATTCACCATCTCCAG GGACAACGCCAAGAACTCACTGTATCTACAAATGAACAGCTGAGAGCCGAGGA CGCGGCCGTGTATCACTGTGCGAGAGGTATAACTGGAACTAACTTCTACCACTA CGGTTTGGGCGTCTGGGGCCAAGGGACCACGGTCACCGTCTCCTCAGCCAGCAC CAAGGGCCCCTCTGTCTTCCCTCTGGCGCCCTGCTCCAGGAGCACCTCTGGCG AACAGCCGCTCTGGGCCTCGGCGCTGCCTTCCCCGAAGGACTACTTCCCCGAGCCTGTGACCGT GTCCTGGAACTCTGGCGCTCTGACCAGCGGAGTGCACACCTTCCCTGCTGTGCT |

SEQUENCE LISTING

| SEQ ID NO: | Name | Description | Sequence |
|---|---|---|---|
| | | | GCAGTCCTCCGGCCTGTACTCCCTGTCCTCCGTCGTGACCGTGCCTTCCAGCTC<br>TCTGGGCACCCAGACCTACATCTGCAACGTGAACCACAAGCCCTCCAACACCAAG<br>GTGGACAAGAAGGTGGAACCCAAGTCCTGCGACAAGACCCACACCTGTCCCCT<br>TGTCCTGCCCCTGAACTGCTGGGCGGACCTTCCGTGTTCCTGTTCCCCCCAAAG<br>CCCAAGGACACCCTGATGATCTCCCGGACCCCTGAAGTGACCTGCGTGGTGTG<br>GATGTGTCCCACGAGGACCCTGAAGTGAAGTTCAATTGGTACGTGGACGGCGTG<br>GAAGTGCACAACGCCAAGACCAAGCCTAGAGAGGAACAGTACAACTCCACCTAC<br>CGGGTGGTGTCCGTGCTGACCGTGCTGCACCAGGATTGGCTGAACGGCAAAGA<br>GTACAAGTGCAAGGTCTCCAACAAGGCCCTGCCTGCCCCATCGAAAAGACCAT<br>CTCCAAGGCCAAGGGCCAGCCCCGGGAACCCCAGGTGTACACACTGCCCCCTAG<br>CAGGGACGAGCTGACCAAGAACCAGGTGTCCCTGACCTGTCTGTGAAAGGCTT<br>CTACCCCTCCGATATCGCCGTGGAGTGGGAGTCCAACGGCCAGCCTGAGAACAA<br>CTACAAGACACCCCCCGTGCTGGACTCCGACGGCTCATTCTTCCTGTACAGC<br>AAGCTGACAGTGGACAAGTCCCGGTGGCAGGAGGGCAACGTGTTCTCCTGTCC<br>GTGATGCACGAGGCCCTGCACAACCACTACACCCAGAAGTCCCTGTCCCTGAGC<br>CCCGGCAAG |
| 248 | 413G05-CDRL1 (IMGT) | Amino acid sequence of CDRL1 of 413G05 using IMGT | QGINSW |
| 249 | 413G05-CDRL2 (IMGT) | Amino acid sequence of CDRL2 of 413G05 using IMGT | AAS |
| 250 | 413G05-CDRL3 (IMGT) | Amino acid sequence of CDRL3 of 413G05 using IMGT | QQVNSFPLT |
| 251 | 413G05-CDRL1 (Kabat) | Amino acid sequence of CDRL1 of 413G05 using Kabat | RASQGINSWLA |
| 252 | 413G05-CDRL2 (Kabat) | Amino acid sequence of CDRL2 of 413G05 using Kabat | AASTLQS |
| 253 | 413G05-CDRL3 (Kabat) | Amino acid sequence of CDRL3 of 413G05 using Kabat | QQVNSFPLT |
| 254 | 413G05-Light chain variable region | Amino acid sequence of V$_L$ of 413G05 | DIQMTQSPSSVSASVGDRVTITCRASQGINSWLAWYQQKPGKAPKLLIYAASTLQS<br>GVPSRFSGSGSGADFTLTISSLQPEDFATYYCQQVNSFPLTFGGGTKVEIK |
| 255 | 413G05-Light chain variable region | Nucleic acid sequence of V$_L$ of 413G05 | GACATCCAGATGACCCAGTCCTCCATCTTCCGTGTCTGCATCTGAGGACAGA<br>GTCACCATCACTTGTCGGGCGAGTCAGGGTATTAACAGCTGGTTAGCCTGGTAT<br>CAGCAGAAACCAGGGAAAGCCCCTAAGCTCCTGATCTATGCTGCATCCACTTTG<br>CAAAGTGGGGTCCCATCAAGGTTCAGCGGCAGTGGTCTGGGGCAGATTTCACT<br>CTCACCATCAGCAGCCTGCAGATTTGCAACTTACTATTGTCAACAGG<br>TTAACAGTTTCCCGCTCACTTTCGGCGGAGGGACCAAGGTGGAGATCAAAC |

| SEQ ID NO: | Name | Description | Sequence |
|---|---|---|---|
| 256 | 413G05-full light chain sequence | Amino acid sequence of 413G05 light chain | DIQMTQSPSSVSASVGDRVTITCRASQGINSWLAWYQQKPGKAPKLLIYAASTLQS GVPSRFSGSGSGADFTLTISSLQPEDFATYYCQQVNSFPLTFGGGTKVEIKRTVAAP SVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 257 | 413G05-full light chain sequence | Nucleic acid sequence of 413G05 light chain | GACATCCAGATGACCCAGTCTCCATCTTCCGTCTGCATCTGAGGAGACAGA GTCACCATCACTTGTCGGGCGAGTCAGGGTATTAACAGCTGGTTAGCCTGGTAT CAGCAGAAACCAGGGAAAGCCCCTAAGCTCCTGATCTATGCTGCATCCACTTTG CAAAGTGGGGTCCCATCAAGGTTCAGCGGCAGTGGATCTGGGACAGATTTCACT CTCACCATCAGCAGCCTGCAGCCTGAAGATTTTGCAACTTACTATTGTCAACAGG TTAACAGTTTCCCGCTCACTTTCGGCGGAGGGACCAAGGTGGAGATCAAACGTA CGGTGGCCGCTCCCTCCGTTCATCTTCCCACCTTCCGACGAGCAGCTGAAGT CCGGACACCGCTTCTGTGTGCCTGCTGAACAACTTCTACCCCGCGAGGCCA AGGTCCAGTGGAAGGTGGACAACGCCCTCCAGTCCGGCAACTCCCAGGAATCCG TGACCGAGCAGGACTCCAAGGACAGCACCTACTCCCTGTCCTCCACCCTGACCC TGTCCAAGGCCGACTACGAGAAGCACAAGGTGTACGCCTGCGAAGTGACCCACC AGGGCCTGTCTAGCCCCGTGACCAAGTCTTTCAACGGGCGAGTGT |
| 258 | 413F09-CDRH1 (IMGT) | Amino acid sequence of CDRH1 of 413F09 using IMGT | GFTFSYYA |
| 259 | 413F09-CDRH2 (IMGT) | Amino acid sequence of CDRH2 of 413F09 using IMGT | ISGGGGNT |
| 260 | 413F09-CDRH3 (IMGT) | Amino acid sequence of CDRH3 of 413F09 using IMGT | AKDRMKQLVRAYYFDY |
| 261 | 413F09-CDRH1 (Kabat) | Amino acid sequence of CDRH1 of 413F09 using Kabat | YYAMS |
| 262 | 413F09-CDRH2 (Kabat) | Amino acid sequence of CDRH2 of 413F09 using Kabat | TISGGGGNTHYADSVKG |
| 263 | 413F09-CDRH3 (Kabat) | Amino acid sequence of CDRH3 of 413F09 using Kabat | DRMKQLVRAYYFDY |
| 264 | 413F09-Heavy chain variable region | Amino acid sequence of $V_H$ of 413F09 | EVPLVESGGGLVQPGGSLRLSCAASGFTFSYYAMSWVRQAPGKGLDWVSTISGGG GNTHYADSVKGRFTISRDNSKNTLYLHMNSLRAEDTAVYYCAKDRMKQLVRAYYF DYWGQGTLVTVSS |
| 265 | 413F09-Heavy chain variable region | Nucleic acid sequence of $V_H$ of 413F09 | GAGGTGCCGCTGGTGGAGTCTGGGGGAGGCTTGGTACAGCCTGGGGGGTCCCT GAGACTCCTCTGTGCAGCCTCTGGATTCACGTTTAGCTATTATGCCATGAGCTG GGTCCGCCAGGCTCCAGGGAAGGGGCTGGACTGGGTCTCAACTATTAGTGGTG GTGGTGGTAACACATACACACTACGACTTCCGTGAAGGGCCGATTCACTATCCA GAGACAATTCCAAGAACACCGCTGTATCTGCACATGAACAGCCTGAGAGCCGAAG ACACGGCCGTCTATTACTGTGCGAAGGATCGGATGAAACAGCTCGTCCGGGCCT ACTACTTTGACTACTGGGGCCAGGGAACCCTGGTCACCGTCTCCTCAG |

SEQUENCE LISTING

| SEQ ID NO: | Name | Description | Sequence |
|---|---|---|---|
| 266 | 413F09-full heavy chain sequence | Amino acid sequence of 413F09 heavy chain | EVPLVESGGGLVQPGSLRLSCAASGFTFSYYAMSWVRQAPGKGLDWVSTISGGG GNTHYADSVKGRFTISRDNSKNTLYLHMNSLRAEDTAVYYCAKDRMKQLVRAYYF DYWGQGTLVTVSSASTKGPSVFPLAPSSKSTSGGTAALGCLVKDYFPEPVTVSWNS GALTSGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVWDVSHEDPEVK FNWYVDGVEVHNAKTKPREEQYNSTYRVVSVLTVLHQDWLNGKEYKCKVSNKALP APIEKTISKAKGQPREPQVYTLPPSRDELTKNQVSLTCLVKGFYPSDIAVEWESNGQ PENNYKTTPPVLDSDGSFFLYSKLTVDKSRWQQGNVFSCSVMHEALHNHYTQKSL SLSPGK |
| 267 | 413F09-full heavy chain sequence | Nucleic acid sequence of 413F09 heavy chain | GAGGTGCCGCTGGTGGAGTCTGGGGGAGGCTTGGTACAGCCTGGGGGGTCCCT GAGACTCTCCTGTGCAGCCTCTGGATTCACGTTTAGCTACTATGCCATGAGCTG GGTCCGTCAGGCTCCAGGGAAGGGGCTGGACTGGGTCTCAACTATTAGTGGTG GTGGTGTAACACACACTACGCAGACTCCGTGAAGGGCCGATTCACTATATCCA GAGACAATTCCAAGAACACGCTGTATCTGCACATGAACAGCCTGAGAGCCGAAG ACACGGCCGTCTATTACTGTGCGAAGGATCGGATGAAAACAGCTCGTCCGGCCT ACTACTTTGACTACTGGGGCCAGGGAACCCTGGTCACCGTCTCCTCAGCCAGCA CCAAGGGCCCCTCGGTGTTCCCCCTGGCCCCATGCAGCAAGTCCACCTCTGGCG GAACAGCGCCTCTGGGCTGCCTCGTGAAGGACTACTTCCCCGAGCCTGTGACCG TGTCCTGGAACTCTGGCGCTCTGACCAGCGGAGTGCACACCTTCCCTGCTGTGC CTCTGCCAACCAGACCTACATCTGCAACGTGAACCACAAGCCCTCCAACACCAA GGTGGACAAGAAGGTGGAACCCAAGTCTTGCGACAAGACCCACACCTGTCCCC TTGTCCTGCCCTGAACTGCTGGGCGGACCCTCCGTGTTCCTGTTCCCTCCCCCAAA GCCCAAGGACACCCTGATGATCTCCCGGACCCCCGAAGTGACCTGCGTGGTGGT GGATGTGTCCCACGAGGACCCTGAAGTGAAGTTCAATTGGTACGTGGACGGCGT GGAAGTGCACAACGCCAAGACCAAGCCTAGAGAGGAACAGTACAACTCCACTA CCGGGTGGTGTCCGTGCTGACCGTGCTGCACCAGGATTGGCTGAACGGCAAAG AGTACAAGTGCAAGGTGCAAGGTGTCCAACAAGGCCCTGCCTGCCCCATCGAAAAGACCA TCTCCAAGGCCAAGGGCCAGCCCCGGGAACCCCAGTGTACACACTGCCCCCTA GCAGGGACGAGCTGACCAAGAACCAGGTGTCCTGACCTGTCTCGTGAAGGCT TCTACCCCTCCGATATCGCCGTGGAATGGGAGTCCAACGGCCAGCCTGAGAACA ACTACAAGAACACCCCCCCTGTCTGGACTCCGACGGCTCATTCTTCCTGTACAG CAAGCTGACAGTGGACAAGTCCCGGTGGCAGCAGGGCAACGTGTTCTCCTGCTC CGTGATGCACGAGGCCCTGCACAACCACTACACCCAGAAGTCCCTGTCCCTGAG CCCGGCAAG |
| 268 | 413F09-CDRL1 (IMGT) | Amino acid sequence of CDRL1 of 413F09 using IMGT | QDISTY |
| 269 | 413F09-CDRL2 (IMGT) | Amino acid sequence of CDRL2 of 413F09 using IMGT | GTS |
| 270 | 413F09-CDRL3 (IMGT) | Amino acid sequence of CDRL3 of 413F09 using IMGT | QQLHTDPIT |

-continued

SEQUENCE LISTING

| SEQ ID NO: | Name | Description | Sequence |
|---|---|---|---|
| 271 | 413F09-CDRL1 (Kabat) | Amino acid sequence of CDRL1 of 413F09 using Kabat | WASQDISTYLG |
| 272 | 413F09-CDRL2 (Kabat) | Amino acid sequence of CDRL2 of 413F09 using Kabat | GTSSLQS |
| 273 | 413F09-CDRL3 (Kabat) | Amino acid sequence of CDRL3 of 413F09 using Kabat | QQLHTDPIT |
| 274 | 413F09-Light chain variable region | Amino acid sequence of V<sub>L</sub> of 413F09 | DIQLTQSPSFLSASVGDRVTITCWASQDISTYLGWYQQKPGKAPKLLIYGTSSLQS GVPSRFSGSGSGTEFTLTISSLQPEDFATYYCQQLHTDPITFGQGTRLEIK |
| 275 | 413F09-Light chain variable region | Nucleic acid sequence of V<sub>L</sub> of 413F09 | GACATCCAGTTGACCCAGTCTCCATCCTTCCTGTCTGCATCTGTAGGAGACAGA GTCACCATCACTTGCTGGGCCAGTCAGGACATTAGCACTTATTTAGGCTGGTAT CAGCAAAAACCAGGGAAAGCCCCTAAGCTCCTGATCTATGGTACATCCAGTTTG CAAAGTGGGGTCCCATCAAGGTTCAGCGGCAGTGGATCTGGGACAGAATTCACT CTCACAATCAGCAGCCTGCAGCCTGAAGATTTTGCAACTTATTACTGTCAACAGC TTCATACTGACCCGATCACCTTCGGCCAAGGGACACGACTGGAGATCAAAC |
| 276 | 413F09-full light chain sequence | Amino acid sequence of 413F09 light chain | DIQLTQSPSFLSASVGDRVTITCWASQDISTYLGWYQQKPGKAPKLLIYGTSSLQS GVPSRFSGSGSGTEFTLTISSLQPEDFATYYCQQLHTDPITFGQGTRLEIKRTVAAP SVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 277 | 413F09-full light chain sequence | Nucleic acid sequence of 413F09 light chain | GACATCCAGTTGACCCAGTCTCCATCCTTCCTGTCTGCATCTGTAGGAGACAGA GTCACCATCACTTGCTGGGCCAGTCAGGACATTAGCACTTATTTAGGCTGGTAT CAGCAAAAACCAGGGAAAGCCCCTAAGCTCCTGATCTATGGTACATCCAGTTTG CAAAGTGGGGTCCCATCAAGGTTCAGCGGCAGTGGATCTGGGACAGAATTCACT CTCACAATCAGCAGCCTGCAGCCTGAAGATTTTGCAACTTATTACTGTCAACAGC TTCATACTGACCCGATCACCTTCGGCCAAGGGACACGACTGGAGATCAAACGTA CGGTGGCCGCTCCCTGTTCATCTTCCCACCTTCGACGAGCAGCTGAAGT CCGGCACCGCTTCTGTCTGTGCCTGCTGAACAACTTCTACCCCCGCGAGGCCA AGTGCAGTGGAAGGTGGACAACGCCCTGCAGTCCGGCAACTCCCAGGAATCCG TGACCGAGCAGGACTCCAAGGACAGCACCTACTCCCTGTCCTCCACCCTGACCC TGTCCAAGGCCGACTACGAGAAGCACAAGGTGTACGCCTGCGAAGTGACCCACC AGGGCCTGTCTAGCCCCGTGACCAAGTCTTTCAACCGGGGCGAGTGT |
| 278 | 414B06-CDRH1 (IMGT) | Amino acid sequence of CDRH1 of 414B06 using IMGT | GFTFSSYW |
| 279 | 414B06-CDRH2 (IMGT) | Amino acid sequence of CDRH2 of 414B06 using IMGT | IKQDGSEK |
| 280 | 414B06-CDRH3 (IMGT) | Amino acid sequence of CDRH3 of 414B06 using IMGT | ARVRQWSDYSDY |

-continued

SEQUENCE LISTING

| SEQ ID NO: | Name | Description | Sequence |
|---|---|---|---|
| 281 | 414B06-CDRH1 (Kabat) | Amino acid sequence of CDRH1 of 414B06 using Kabat | SYWMN |
| 282 | 414B06-CDRH2 (Kabat) | Amino acid sequence of CDRH2 of 414B06 using Kabat | NIKQDGSEKYYVDSVKG |
| 283 | 414B06-CDRH3 (Kabat) | Amino acid sequence of CDRH3 of 414B06 using Kabat | VRQWSDYSDY |
| 284 | 414B06-Heavy chain variable region | Amino acid sequence of V$_H$ of 414B06 | EVHLVESGGGLVQPGGSLRLSCAASGFTFSSYWMNWVRQAPGKGLEWVANIKQD GSEKYVDSVKGRFTVSRDNAKNSLYLQMNSLRAEDTAVYYCARVRQWSDYSDY WGQGTPVTVSS |
| 285 | 414B06-Heavy chain variable region | Nucleic acid sequence of V$_H$ of 414B06 | GAGGTGCACCTGGTGGAGTCTGGGGGAGGCTTGGTCCAGCCTGGGGGGTCCT GAGACTCTCCTGTGCAGCCTCTGGATTCACCTTTAGTAGCTATTGGATGAACTG GGTCCGCCAGGCTCCAGGGAAGGGGCTGGAGTGGGTGGCCAACATAAAGCAAG ATGGAAGTGAGAAATACTATGTGGACTCTGTGAAGGGCCGCTTCACCGTCTCCA GAGACAACGCCAAGAACTCACTGTATCTGCAAATGAACAGCCTGAGAGCCGAGG ACACGGCTGTGTATTACTGTGCGAGAGTTCGACAATGGTCCGACTACTCTGACT ACTGGGGCCAGGGAACCCCGGTCACCGTCTCCTCAG |
| 286 | 414B06-full heavy chain | Amino acid sequence of 414B06 heavy chain | EVHLVESGGGLVQPGGSLRLSCAASGFTFSSYWMNWVRQAPGKGLEWVANIKQD GSEKYVDSVKGRFTVSRDNAKNSLYLQMNSLRAEDTAVYYCARVRQWSDYSDY WGQGTPVTVSSASTKGPSVFPLAPSSKSTSGGTAALGCLVKDYFPEPVTVSWNSGA LTSGVHTFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHEDPEVKFN WYVDGVEVHNAKTKPREEQYNSTYRWSVLTVLHQDWLNGKEYKCKVSNKALPAP IEKTISKAKGQPREPQVYTLPPSRDELTKNQVSLTCLVKGFYPSDIAVEWESNGQPE NNYKTTDPVLDSDGSFFLYSKLTVDKSRWQQGNVFSCSVMHEALHNHYTQKSLSL SPGK |
| 287 | 414B06-full heavy chain sequence | Nucleic acid sequence of 414B06 heavy chain | GAGGTGCACCTGGTGGAGTCTGGGGGAGGCTTGGTCCAGCCTGGGGGGTCCT GAGACTCTCCTGTGCAGCCTCTGGATTCACCTTTAGTAGCTATTGGATGAACTG GGTCCGCCAGGCTCCAGGGAAGGGGCTGGAGTGGGTGGCCAACATAAAGCAAG ATGGAAGTGAGAAATACTATGTGGACTCTGTGAAGGGCCGCTTCACCGTCTCCA GAGACAACGCCAAGAACTCACTGTATCTGCAAATGAACAGCCTGAGAGCCGAGG ACACGGCTGTGTATTACTGTGCGAGAGTTCGACAATGGTCCGACTACTCTGACT ACTGGGGCCAGGGAACCCCGGTCACCGTCTCCTCAGCCTCCACCAAGGGCCCT CTGTGTTCCCTGGCCCCTTCCAGCAAGTCCACCTCTGGCGGAACAGCCGCTC TGGGCTGCCTGGTGAAGGACTACTTCCCGAGCCTGTGACCGTGTCGTGAACT CTGGCCCTCTGACCAGCGGAGTGCACACCTTCCCTGCCGTTCTGCAGTCCTCG GCCTGTACTCCCTGTCCTCCGTGGTGACCGTGCCTTCCAACAGTGGACACCC AGACCTACATCTGCAACGTGAACCACAAGCCCTCCAACACCAAGGTGGACAAGA AGGTGGAACCCAAGTCCTGCGACAAGACCCACACCTGTCCCCCTTGTCCTGCCC CTGAACTGCTGGGCGGACCTTCCGTGTTCCTGTTCCCCCCAAAGCCAAGGACA CCCTGATGATCTCCCGGACCCCGAAGTGACCTGCGTGGTGGATGTCCC ACGAGGACCCTGAAGTGAAGTTCAATTGGTACGTGGACGGCGTGGAAGTGCACA ACGCCAAGACCAAGCCTAGAGAGGAACAGTACAACTCCACCTACCGGGTGTGT |

| SEQ ID NO: | Name | Description | Sequence |
|---|---|---|---|
| | | | CCGTGCTGACCGTGCTGCACCAGGATTGGCTGAACGCGAAGAGTACAAGTGCA |
| | | | AGGTGTCCAACAAGGCCCTGCCTGCCCCATCGAAAAGACCATCTCCAAGGCA |
| | | | AGGGCCAGCCCGGAACCCCAGGTGTACACACTGCCCCCTAGCAGGGACGAGC |
| | | | TGACCAAGAACCAGGTGTCCCTGACCTGTCTGGTGAAAGGCTTCTACCCCTCCG |
| | | | ATATCGCCGTGAATGGGAGTCCAACGGCCAGCCTCATTCTTCGTACAGCAAGCTGACAG |
| | | | CCCCCCTGTGCTGGACTCCGACGGCTCATTCTTCCTGTACAGCAAGCTGACAG |
| | | | TGGACAAGTCCCGGTGGCAGCAGGGCAACGTGTTCTCCTGCTCCGTGATGCACG |
| | | | AGGCCCTGCACAACCACTACACCCAGAAGTCCCTGTCCCTGAGCCCGGCAAG |
| 288 | 414B06-CDRL1 (IMGT) | Amino acid sequence of CDRL1 of 414B06 using IMGT | QGISSW |
| 289 | 414B06-CDRL2 (IMGT) | Amino acid sequence of CDRL2 of 414B06 using IMGT | AAS |
| 290 | 414B06-CDRL3 (IMGT) | Amino acid sequence of CDRL3 of 414B06 using IMGT | QQANSFPFT |
| 291 | 414B06-CDRL1 (Kabat) | Amino acid sequence of CDRL1 of 414B06 using Kabat | RASQGISSWLA |
| 292 | 414B06-CDRL2 (Kabat) | Amino acid sequence of CDRL2 of 414B06 using Kabat | AASSLQS |
| 293 | 414B06-CDRL3 (Kabat) | Amino acid sequence of CDRL3 of 414B06 using Kabat | QQANSFPFT |
| 294 | 414B06-Light chain variable region | Amino acid sequence of V$_L$ of 414B06 | DIQMTQSPSSVSASVGDRVTITCRASQGISSWLAWYQQKPGKAPKLLIYAASSLQS GVPSRFSGSGSGTDFTLTISSLQPEDFATYYCQQANSFPFTFGPGTKVDIK |
| 295 | 414B06-Light chain variable region | Nucleic acid sequence of V$_L$ of 414606 | GACATCCAGATGACCCAGTCTCCATCTTCCGTGTCTGCATCTGTAGGAGACAGA GTCACCATCACTTGTCGGGCGAGTCAGGGTATTAGCAGCTGGTTAGCCTGGTAT CAGCAGAAACCAGGAAAGCCCCTAAGCTCCTGATCTATGCTGCATCCAGTTTG CAAAGTGGGGTCCCATCAAGGTTCAGCGGCAGTGGATCTGGGACAGATTTCACT CTCACCATCAGCAGCCTGCAGCCTGAAGATTTTGCAACTTACTATTGTCAACAGG CTAACAGTTTCCCATTCACTTTCGGCCCTGGGACCAAAGTGGATATCAAAC |
| 296 | 414B06-full light chain | Amino acid sequence of 414B06 light chain | DIQMTQSPSSVSASVGDRVTITCRASQGISSWLAWYQQKPGKAPKLLIYAASSLQS GVPSRFSGSGSGTDFTLTISSLQPEDFATYYCQQANSFPFTFGPGTKVDIKRTVAAP SVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 297 | 414B06-full light chain sequence | Nucleic acid sequence of 414B06 light chain | GACATCCAGATGACCCAGTCTCCATCTTCCGTGTCTGCATCTGTAGGAGACAGA GTCACCATCACTTGTCGGGCGAGTCAGGGTATTAGCAGCTGGTTAGCCTGGTAT CAGCAGAAACCAGGAAAGCCCCTAAGCTCCTGATCTATGCTGCATCCAGTTTG CAAAGTGGGGTCCCATCAAGGTTCAGCGGCAGTGGATCTGGGACAGATTTCACT CTCACCATCAGCAGCCTGCAGCCTGAAGATTTTGCAACTTACTATTGTCAACAGG |

-continued

SEQUENCE LISTING

| SEQ ID NO: Name | Description | Sequence |
|---|---|---|
| | | CTAACAGTTCCCATTCACTTTCGGCCCTGGGACCAAAGTGGATATCAAACGTAC GGTGGCCGCTCCCTCCGTGTTCATCTTCCCACCTTCCGACGAGCAGCTGAAGTC CGGCACCGCTTCTGTCGTGTGCCTGCTGAACAACTTCTACCCCCGAGGCCAA GGTCAGTGGAAGGTGGACAACGCCCTGCAGTCCGGCAACTCCCAGGAATCGT GACCGAGCAGGACTCCAAGGACAGCACCTACTCCCTGTCCTCCACCCTGACCCT GTCCAAGGCCGACTACGAGAAGCACAAGGTGTACGCTGCGAAGTGACCACCA GGGCCTGTCTAGCCCCGTGACCAAGTCTTTCAACCGGGGCGAGTGT |
| 298 Mutated 1D05-LC mutant 3 | Amino acid sequence of 1D05 kappa light chain with V to Y mutation in CDRL2 highlighted | DIQMTQSPSSLSASVGDRVTITCRASQSISSYLNWYQQKPGKAPKLLIYASSLQS GVPSRFSGSGSGTDFLTISSLQPEDFATYYCQQSYSTPITFGQGTRLEIKRIVAAP SVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 299 1D05-heavy chain disabled IgG1 Fc | Amino acid sequence of IgG1 disabled variant of 1D05 | EVQLVESGGGLVQPGRSLRLSCAASGFTFDDYAMHWVRQVPGKGLEWVSGISWI RTGIGYADSVKGRFTIFRDNAKNSLYLQMNSLRAEDTALYYCAKDMKGSGTYGGW FDTWGQGTLVTVSSASTKGPSVFPLAPSSKSTSGGTAALGCLVKDYFPEPVTVSWN SGALTSGVHTFPAVLQSSGLYSLSSVVTVPSSSLGTQTYICNVNHKPSNTINDKVE PKSCDKTHTCPPCPAPELAGAPSVFLFPPKPKDTLMISRTPEVTCVVVDVSHEDPE VKFNWYVDGVEVHNAKTKPREEQYNSTYRVVSVLTVLHQDWLNGKEYKCKVSNK ALPAPIEKTISKAKGQPREPQVYTLPPSRDELTKNQVSLTCLVKGFYPSDIAVEWES NGQPENNYKTTPPVLDSDGSFFLYSKLTVDKSRWQQGNVFSCSVMHEALHNHYT QKSLSLSPGK |
| 300 1D05-light chain IL-2 fusion | 1D05 Light chain sequence fused to wild-type human IL-2 sequence (IL-2 amino acid sequence is underlined and region to be varied is shown in bold) | DIQMTQSPSSLSASVGDRVTITCRASQSISSYLNWYQQKPGKAPKLLIYASSLQS GVPSRFSGSGSGTDFLTISSLQPEDFATYYCQQSYSTPITFGQGTRLEIKRTVAAP SVFIFPPSDEQLKSGTASVVCLLNNFYPREAWQWKVDNALQSGNSQESVTEQDSK DSTYSLSSTLTLSKADYEKHKVYACEVTHQGLSSPVTKSFNRGECAPTSSSTKKT <u>QLQLEHLLLDLQMILNGINNYKNPKLTRMLTFKFYMPKKATELKHLQCLEEELKPL EEVLNLAQSKNFHLRPRDLISNINVIVLELKGSETTFMCEYADETATIVEFLNRWITF CQSIISTLT</u> |
| 301 Human IL-2 | Uniprot number: P60568 Full length amino acid sequence of human IL-2 (minus signal sequence) | APTSSSTKKTQLQLEHLLLDLQMILNGINNYKNPKLTRMLTFKFYMPKKATELK HLQCLEEELKPLEEVLNLAQSKNFHLRPRDLISNINVIVLELKGSETTFMCEYADETA TIVEFLNRWITFCQSIISTLT |
| 302 Control 1D05 immunocytokine HC C-terminal fusion | Heavy chain 1D05 IgG1 variant fused at the N-terminus to wild-type human IL2 sequence (control) | EVQLVESGGGLVQPGRSLRLSCAASGFTFDDYAMHWVRQVPGKGLEWVSGISWI RTGIGYADSVKGRFTIFRDNAKNSLYLQMNSLRAEDTALYYCAKDMKGSGTYGGW FDTWGQGTLVTVSSASTKGPSVFPLAPSSKSTSGGTAALGCLVKDYFPEPVTVSWN SGALTSGVHTCPPCPAPELAGAPSVFLFPPKPKDTLMISRTPEVTCVVVDVSHEDPE VKFNWYVDGVEVHNAKTKPREEQYNSTYRVVSVLTVLHQDWLNGKEYKCKVSNK ALPAPIEKTISKAKGQPREPQVYTLPPSRDELTKNQVSLTCLVKGFYPSDIAVEWES NGQPENNYKTTPPVLDSDGSFFLYSKLTVDKSRWQQGNVFSCSVMHEALHNHYT QKSLSLSPGKAPTSSSTKKTQLQLEHLLLDLQMILNGINNYKNPKLTRMLTFKFYMP KKATELKHLQCLEEELKPLEEVLNLAQSKNFHLRPRDLISNINVIVLELKGSETTFMC EYADETATIVEFLNRWITFCQSIISTLT |

SEQUENCE LISTING -continued

| SEQ ID NO: | Name | Description | Sequence |
|---|---|---|---|
| 303 | IL-2 D5-9 | IL-2 IC45 (Del 5-9) N terminal IL-2 sequence | APTSTQLELLLD |
| 304 | IL-2 D1-9 | IL-2 IC46 (Del 1-9) N terminal IL-2 sequence | TQLQLEHLLLD |
| 305 | IL-2 D5-7 | IL-2 IC64 (Del 5-7) N terminal IL-2 sequence | APTSKKTQLEHLLLD |
| 306 | IL-2 D1 | IL-2 D1 N terminal IL-2 sequence | PTSSSTKKTQLQLEHLLLD |
| 307 | IL-2 D1-2 | IL-2 D1-2 N terminal IL-2 sequence | TSSSTKKTQLQLEHLLLD |
| 308 | IL-2 D1-3 | IL-2 D1-3 N terminal IL-2 sequence | SSSTKKTQLQLEHLLLD |
| 309 | IL-2 D1-4 | IL-2 D1-4 N terminal IL-2 sequence | SSTKKTQLQLEHLLLD |
| 310 | IL-2 D1-5 | IL-2 D1-5 N terminal IL-2 sequence | STKKTQLQLEHLLLD |
| 311 | IL-2 D1-6 | IL-2 D1-6 N terminal IL-2 sequence | TKKTQLQLEHLLLD |
| 312 | IL-2 D1-7 | IL-2 D1-7 N terminal IL-2 sequence | KKTQLQLEHLLLD |
| 313 | IL-2 D1-8 | IL-2 D1-8 N terminal IL-2 sequence | KTQLQLEHLLLD |
| 314 | IL-2 D9 | IL-2 D9 N terminal IL-2 sequence | APTSSSTKTQLQLEHLLLD |
| 315 | IL-2 D9-8 | IL-2 D9-8 N terminal IL-2 sequence | APTSSSTTQLQLEHLLLD |
| 316 | IL-2 D9-7 | IL-2 D9-7 N terminal IL-2 sequence | APTSSSTQLQLEHLLLD |
| 317 | IL-2 D9-6 | IL-2 D9-6 N terminal IL-2 sequence | APTSSTQLQLEHLLLD |
| 318 | IL-2 D9-4 | IL-2 D9-4 N terminal IL-2 sequence | APTTQLQLEHLLLD |

-continued

SEQUENCE LISTING

| SEQ ID NO: | Name | Description | Sequence |
|---|---|---|---|
| 319 | IL-2 D9-3 | IL-2 D9-3 N terminal IL-2 sequence | APTQLQLEHLLLD |
| 320 | IL-2 D9-2 | IL-2 D9-2 N terminal IL-2 sequence | ATQLQLEHLLLD |
| 321 | IL-2 D2-6 | IL-2 D2-6 N terminal IL-2 sequence | ATKKTQLQLEHLLLD |
| 322 | IL-2 D3-7 | IL-2 D3-7 N terminal IL-2 sequence | APKKTQLQLEHLLLD |
| 323 | IL-2 D4-8 | IL-2 D4-8 N terminal IL-2 sequence | APTKTQLQLEHLLLD |
| 324 | C-terminal amino acid sequence of hIL-2 | Amino acids 21 to 133 of hIL-2 | LQMILNGINNYKNPKLTRMLTFKFYMPKKATELKHLQCLEEELKPLEEVLNLAQSKN FHLRPRDLISNINVIVLELKGSETTFMCEYADETATIVEFLNRWITFCQSIISTLT |
| 325 | Mouse PD-L1 | Uniprot number: Q9EP73 (ECD highlighted in BOLD, and cytoplasmic domain underlined) | MRIFAGIIFTACCHLLRAFTITAPKDLYWEYGSNVTMECRFPVERELDLLAL VVYWEKEDEQVIQFVAGEEDLKPQHSNFRGRASLPKDQLLKGNAALQIT DVKLQDAGVYCCIISYGGADYKRITLKVNAPYRKINQRISVDPATSEHEL ICQAEGYPEAEVIWTNSDHQPVSGKRSVTTSRTEGMLLNVTSSLRVNAT ANDVFYCTFWRSQPGQNHTAELIIPELPATHPPQNRTHWVLLGSILLFLIW STVLLFLRKQVRMLDVEKCGVEDTSSKNRNDTQFEET |
| 326 | Mouse PD-L1 ECD His | Mouse PD-L1 extracellular domain with his tag | FTITAPKDLYVVEYGSNVTMECRFPVERELDLLALVVYWEKEDEQVIQFVAGEEDLK PQHSNFRGRASLPKDQLLKGNAALQITDVKLQDAGVYCCIISYGGADYKRITLKVN APYRKINQRISVDPATSEHELICQAEGYPEAEVIWTNSDHQPVSGKRSVTTSRTEG MLLNVTSSLRVNATANDVFYCTFWRSQPGQNHTAELIIPELPATHPPQNR<u>THHHH HH</u> |
| 327 | Human IL-2Ra chain | Human IL-2 receptor alpha chain | ELCDDDPPEIPHATFKAMAYKEGTMLNCECKRGFRRIKSGSLYMLCIGNSSHSSW DNQCQCTSSATRNTTKQVTPQPEEQKERKTTEMQSMQPVDQASLPGHCREPPP WENEATERIYHFWGQMVYYQCVQGYRALHRGPAESVCKMTHGKTRWTQPQLIC TGEMETSQFPGEEKPQASPEGRPESETSCLVTTTDFQIQTEMAATMETSIPTTEYQ VAVAGCVFLLISVLLLSGLTWQRRQRKSRRTI |
| 328 | Human IL-2Rβ chain | Human IL-2 receptor beta chain | AVNGTSQFTCFYNSRANISCVWSQDGALQDTSCQVHAWPDRRRWNQTCELLPVS QASWACNLILGAPDSQKLTTVDIVTLRVLCREGVRWRVMAIQDFKPFENLRLMAPI SLQVVHVETHRCNISWEISQASHYFERHLEFEARTLSPGHTWEEAPLLTLKQKQE WICLETLTPDTQYEFQVRVKPLQGEFTTWSPWSQPLAFRTKPAALGKDTIPWLGH LLVGLSGAFGFIILVLLINCRNTGPWLKINLKCNTPDPSKFFSQLSSEHGGDVQKW LSSPPSSSFSPGGLAPEISPLEVLERDKVTQLLLQQDKVPEPASLSSNHSLTSCFTN QGYFFHLPDALEIEACQVYFTYDPYSEEDPDEGVAGAPTGSSPQPLQPLSGEDDA YCTFPSRDDLLLFSPSLLGGPSPPSTAPGGSGAGEERMPPSLQERVPRDWDPQPLG PPTPGVPDLVDFQPPPELVLREAGEEVPDAGPREGVSFPWSRPPGQGEFRALNARL PLNTDAYLSLQELQGQDPTHLV |

-continued

SEQUENCE LISTING

| SEQ ID NO: | Name | Description | Sequence |
|---|---|---|---|
| 329 | Human IL-2Rγ chain | Human IL-2 receptor common gamma chain | LNTTILTPNGNEDTTADFFLTTMPTDSLSVSTLPLPEVQCFVFNVEYMNCTWNSSS EPQPTNLTLHYWYKNSDNDINQKCSHYLFSEITSGCQLQKKEIHLYQTFVVQLQD PREPRRQATQMLKLQNLVIPWAPENLTLHKLSESQLELNWNNRFLNHCLEHLVQY RTDWDHSWTEQSVDYRHKFSLPSVDGQKRYTFRVRSRFNPLCGSAQHWSEWSH PIHWGSNTSKENPFLFALEAWISVGSMGLIISLLCVYFWLERTMPRIPTLKNLEDLV TEYHGNFSAWSGVSKGLAESLQPDYSERLCLVSEIPPKGGALGEGPGASPCNQHSP YWAPPCYTLKPET |
| 330 | IL-7 | Human IL-7 amino acid sequence | DCDIEGKDGKQYESVLMVSIDQLLDSMKEIGSNCLNNEFNFFKRHICDANKEGMFL FRAARKLRQFLKMNSTGDFDLHLLKVSEGTTILLNCTGQVKGRKPAALGEAQPTKS LEENKSLKEQKKLNDLCFLKRLLQEIKTCWNKILMGTKEH |
| 331 | IL-15 | Human IL-15 amino acid sequence | GIHVFILGCFSAGLPKTEAWVNVISDLKKIEDLIQSMHIDATLYTESDVHPSCKVT AMKCELLELQVISLESGDASIHDTVENLIILANNSLSSNGNVTESGCKECEELEEKNI KEFLQSFVHIVQMFINTS |
| 332 | IL-21 | Human IL-21 amino acid sequence | QGQDRHMIRMRQLIDIVDQLKNYVNDLVPEFLPAPEDVETNCEWSAFSCFQKAQL KSANTGNNERIINVSIKKLKRKPPSTNAGRRQKHRLTCPSCDSYEKKPPKEFLERFK SLLQKMIHQHLSSRTHGSEDS |
| 333 | GM-CSF | Human GM-CSF amino acid sequence | APARSPSPSTQPWEHVNAIQEARRLLNLSRDTAAEMNETVEVISEMFDLQEPTCLQ TRLELYKQGLRGSLTKLKGPLTMMASHYKQHCPPTPETSCATQIITFESFKENLKDF LLVIPFDCWEPVQE |
| 334 | IFNα | Human IFN-α amino acid sequence | CDLPQNHGLLSRNTLVLLHQMRRISPFLCLKDRDRFPQEMVKGSQLQKAHVMS VLHEMLQQIFSLFHTERSSAAWNMTLLDQLHTEHQQLQHLETCLLQVVGEGESA GAISSPALTLRRYFQGIRVYLKEKKYSDCAWEVVRMEIMKSLELSTNMQERLRSKD RDLGS |
| 335 | TNFα | Extracellular portion of human TNF-α amino acid sequence | GPQREFPRDLSLISPLAQAVRSSSRTPSDKPVAHVVANPQAEGQLQWLNRRANAL LANGVELRDNQLVVPSEGLYLIYSQVLFKGQGCPSTHVLLTHTISRIAVSYQTKVNL LSAIKSPCQRETPEGAEAKPWYEPIYLGGVFQLEKGDRLSAEINRPDYLDFAESGQV YFGIIAL |
| 336 | IL-12a | Alpha chain of human IL-12 amino acid sequence | RNLPVATPDPGMFPCLHHSQNLLRAVSNMLQKARQTLEFYPCTSEEIDHEDITKDK TSTVEACLPLELTKNESCLNSRETSFITNGSCLASRKTSFMMALCLSSIYEDLKMYQ VEEKTMNAKLLMDPKRQIELDQNMLAVIDELMQALNFNSETVPQKSSLEEPDFYKT KIKLCILLHAFRIRAVTIDRVMSYLNAS |
| 337 | IL-12β | Beta chain of human IL-12 amino acid sequence | IWELKKDVYVVELDWYPDAPGEMVLICDTPEEDGITWTLDQSSEVLGSGKTLTI QVKEFGDAGQYTCHKGGEVLSHSLLLLHKKEDGIWSTDILKDQKEPKNKTFLRCEA KNYSGRETCWWLTTISTDLTFSVKSSRGSSDPQGVTCGAATLSAERVRGDNKEYE YSVECQEDSACPAAEESLPIEVMVDAVHKLKYENTSSFFIRDIIKPDPPKNLQLKPL KNSRQVEVSWEYPDTWSTPHSYFSLTFCVQVQGKSKREKKDRVETDKTSATVICR KNASISVRAQDRYYSSSWSEWASVPCS |

SEQUENCE LISTING -continued

| SEQ ID NO: | Name | Description | Sequence |
|---|---|---|---|
| 338 | CXCL9 | Human CXCL-9 amino acid sequence | TPVVRKGRCSCISTNQGTIHLQSLKDLKQFAPSPSCEKIEIIATLKNGVQTCLNPDSA DVKELIKKWEKQVSQKKKQKNGKKHQKKKVLKMRKSQRSRQKKTT |
| 339 | CXCL10 | Human CXCL-10 amino acid sequence | VPLSRTVRCTCISISNQPVNPRSLEKLEIIPASQFCPRVEIIATMKKKGEKRCLNPESK AIKNLLKAVSKERSKRSP |
| 340 | Human WT IgG1 constant region | IGHG1*01 & IGHG1*02 & IGHG1*05 (IgG1) | WT human IgG1 amino acid sequence | ASTKGPSVFPLAPSSKSTSGGTAALGCLVKDYFPEPVTVSWNSGALTSGVHTFPAVL QSSGLYSLSSVVTVPSSSLGTQTYICNVNHKPSNTKVDKKVEPKSCDKTHTCPPCP APELLGGPSVFLFPPKPKDTLMISRTPEVTCVVVDVSHEDPEVKFNWYVDGVEVHN AKTKPREEQYNSTYRVVSVLTVLHQDWLNGKEYKCKVSNKALPAPIEKTISKAKGQ PREPQVYTLPPSRDELTKNQVSLTCLVKGFYPSDIAVEWESNGQPENNYKTTPPVL DSDGSFFLYSKLTVDKSRWQQGNVFSCSVMHEALHNHYTQKSLSLSPGK |
| 341 | | WT human IgG1 nucleic acid sequence | GCCAGCACCAAGGGCCCCTCTGTGTTCCCTGGCCCTTCCAGCAAGTCCACC TCTGGCGGAACAGCCGCTCTGGGCTGCCTCGTGAAGGACTACTTCCCCGAGCCT GTGACCGTGTCTGGAACTCTGGCGTTCTCCGGCGTGCACACCTTCCCT GCTGTCGCAGTCCTGCAGTCCTCCGGCCTGTATCCCTGTCTGTCACCGTGCCT TCCAGCTCTCTGCAGACCTACATCTGCAACGTGAACCACAAGCCCTCCA ACACCAAGGTGGACAAGAAGGTGGAACCCAAGTCTGCGACAAGACCCACACCT GTCCCCCCTGTCCTGCCCCGATGATCTCCCGGACCCCTGAAGTGACCTGC TGGTGGTGGATGTGTCCACGAGGACCCTGAAGTGAAGTTCAATTGGTACGTGG ACGGCGTGGAAGTGCACAACGCCAAGACCAAGCCTAGAGAGGAACAGTACAACT CCACCTACCGGGTGGTGTCCGTGCTGACCGTGCTGCACCAGGATTGGCTGAACG GCAAAGAGTACAAGTGCAAGGTCCTCCAACAAGGCCCTGCCCCATCGAAA AGACCATCTCCAAGGCCAAGGGCCAGCCCCGGGAACCCAGGTGTACACACTGC CCCCTAGCAGGGACGAGCTGACCAAGAACCAGGTGTCCCTGACCTGTCTCGTGA AAGGCTTCTACCCCTCCGATATCGCCGTGGAATGGGAGTCCAACGGCCAGCCTG AGAACAACTACAAGACCACCCCTCCTGTGCTGGACTCCGACGGCTCATTCTTCCT GTACAGCAAGCTGACAGTGGACAAGTCCGGTGGCAGCAGGGCAACGTGTTCTC CTGCTCCGTGATGCACGAGGCCCTGCACAACCACTACACCCAGAAGTCCCTGTC CCTGAGCCCCGGCAAGTGATGA |
| 342 | Mutated 1D05-HC mutant 2 | Amino acid sequence of 1D05 heavy chain with V to A and F to S back-mutation in framework region to germline highlighted with IgG1 disabled (LAGA) constant region | EVQLVESGGGLVQPGRSLRLSCAASGFTFDDYAMHWVRQAPGKGLEWVSGISWI RTGIGYADSVKGRFTISRDNAKNSLVLQMNSLRAEDTALYYCAKDMKGSGTYGGW FDTWGQGTLVTVSSASTKGPSVFPLAPCSRSTSESTAALGCLVKDYFPEPVWSWN SGALTSGVHTFPAVLQSSGLYSLSSVVTVPSSSLGTKTYTCNVDHKPSNTKVDKRV ESKYGPPCPPCPAPELAGAPSVFLFPPKPKDTLMISRTPEVTCVVVDVSQEDPEVQF NWYVDGVEVHNAKTKPREEQFNSTYRVVSVLTVLHQDWLNGKEYKCKVSNKGLP SSIEKTISKAKGQPREPQVYTLPPSQEEMTKNQVSLTCLVKGFYPSDIAVEWESNG QPENNYKTTPPVLDSDGSFFLYSRLTVDKSRWQEGNVFSCSVMHEALHNHYTQKS LSLSLGK |
| 343 | 416E01-CDRH1 (IMGT) | Amino acid sequence of CDRH1 of 416E01 using IMGT | GFTFSNYA |

| SEQ ID NO: | Name | Description | Sequence |
|---|---|---|---|
| 344 | 416E01-CDRH2 (IMGT) | Amino acid sequence of CDRH2 of 416E01 using IMGT | ISFSGTT |
| 345 | 416E01-CDRH3 (IMGT) | Amino acid sequence of CDRH3 of 416E01 using IMGT | AKDEAPAGATFFDS |
| 346 | 416E01-CDRH1 (Kabat) | Amino acid sequence of CDRH1 of 416E01 using Kabat | NYAMS |
| 347 | 416E01-CDRH2 (Kabat) | Amino acid sequence of CDRH2 of 416E01 using Kabat | AISFSGTTYADSVKG |
| 348 | 416E01-CDRH3 (Kabat) | Amino acid sequence of CDRH3 of 416E01 using Kabat | DEAPAGATFFDS |
| 349 | 416E01-Heavy chain variable region | Amino acid sequence of V$_H$ of 416E01 (mutations from germline are shown in bold letters) | EVQLAESGGGLVQPGGSLRLSCAASGFTFSNYAMSWVRQTPGKGLEWVSAISFSG GTTYYADSVKGRFTISRDNSKNTLYLHMNSLRADDTAVYYCAKDEAPAGATFFDS WGQGTLVTVSS |
| 350 | 416E01-Heavy chain variable region | Nucleic acid sequence of V$_H$ of 416E01 | GAAGTGCAACTGGCGGAGTCTGGGGGAGGCTTGGTACAGCCTGGGGGGTCCCT GAGACTCTCCTGTGCAGCCTCTGGATTCACCTTTAGCAACTATGCCATGAGTTG GGTCCGCCAGACTCCAGGAAAGGGGCTGGAGTGGGTCTCAGCTATTAGTTTTAG TGGTGGTACTACATACTACGCTGACTCCGTGAAGGGCCGGTTCACCATCTCCAG AGACAATTCCAAGAACACGCTGTATTTGCACATGAACAGCCTGAGAGCCGATGA CACGGCCGTATATTACTGTGCGAAAGATGAGGCACCAGCTGGCGCAACCTTCTT TGACTCCTGGGGCCAGGGAACGCTGGTCACCGTCTCCTCAG |
| 351 | 416E01-full heavy chain sequence | Amino acid sequence of 416E01 heavy chain | EVQLAESGGGLVQPGGSLRLSCAASGFTFSNYAMSWVRQTPGKGLEWVSAISFSG GTTYYADSVKGRFTISRDNSKNTLYLHMNSLRADDTAVYYCAKDEAPAGATFFDS WGQGTLVTVSSASTKGPSVFPLAPCSRSTSESTAALGCLVKDYFPEPVTVSWNSGA LTSGVHTFPAVLQSSGLYSLSSVVTVPSSSLGTKTYTCNVDHKPSNTINDKRVESKY GPPCPPCPAPEFEGGPSVFLFPPKPKDTLMISRTPEVTCVVVDVSQEDPEVQFNWY VDGVEVHNAKTKPREEQFNSTYRVVSVLTVLHQDWLNGKEYKCKVSNKGLPSSIEK TISKAKGQPREPQVYTLPPSQEEMTKNQVSLTCLVKGFYPSDIAVEWESNGQPENN YKTTPPVLDSDGSFFLYSRLIVDKSRWQEGNVFSCCSVMHEALHNHYTQKSLSLSLG K |
| 352 | 416E01-full heavy chain sequence | Nucleic acid sequence of 416E01 heavy chain | GAAGTGCAACTGGCGGAGTCTGGGGGAGGCTTGGTACAGCCTGGGGGGTCCCT GAGACTCTCCTGTGCAGCCTCTGGATTCACCTTTAGCAACTATGCCATGAGTTG GGTCCGCCAGACTCCAGGAAAGGGGCTGGAGTGGGTCTCAGCTATTAGTTTTAG TGGTGGTACTACATACTACGCTGACTCCGTGAAGGGCCGGTTCACCATCTCCAG AGACAATTCCAAGAACACGCTGTATTTGCACATGAACAGCCTGAGAGCCGATGA CACGGCCGTATATTACTGTGCGAAAGATGAGGCACCAGCTGGCGCAACCTTCTT TGACTCCTGGGGCCAGGGAACGCTGGTCACCGTCTCCTCAGCCTCCACCAAGGG CCCTTCCGTGTTCCCCCTGGCCCCTTGCAGCCAGGACCTGCTGGAGCGCCAGC TGCCCTGGCGTCTGTGAAGGACTACTTTCCCGAGCCGCCTGACCGTGAGCTG |

SEQUENCE LISTING

| SEQ ID NO: | Name | Description | Sequence |
|---|---|---|---|
| | | | GAACAGCGGCGCCTCTGACATCCGGCTCCACACCTTTCTGCCGTCCTGCAGTC<br>CTCCGGCCTCTACTCCCTGTCCTCCGTGGTGACCGTGCCTAGCTCCTCCTCGG<br>CACCAAGACCTACACCTGTAACGTGACCACCAAACCCTCCAACACCAAGTGGAC<br>AAACGGGTCGAGAGCAAGTACGGCCCCTCCTGCCCTCCTGTCCTGCCCCGAG<br>TTCGAAGGCCGACCCAGCGTGTTCCTGTTCCCTCCTAAGCCCAAGGACACCCTC<br>ATGATCAGCCGGACACCCGAGGTGACCTGCGTGGTGGTGGATGTGAGCCAGGA<br>GGACCCTGAGGTCCAGTTCAACTGGTATGTGGATGGCGTGGAGGTGCACAACG<br>CCAAGACAAAGCCCCGGGAAGAGCAGTTCAACTCCACCTACAGGGTGGTCAGCG<br>TGCTGACCGTCGTGCATCAGGACTGGCTGAACGGCAAGGAGTACAAGTGCAAG<br>GTCAGCAATAAGGACTTCCAAACCATCTCCAAGGCTAAA<br>GGCCAGCCCCGGGAACCTCAGGTGTACACCCTGCCTCCCAGCCAGGAGGAGATG<br>ACCAAGAACCAGGTGAGCCTGACCTGCCTGGTGAAGGGATTCTACCCTTCGAC<br>ATCGCCGTGGAGTGGGAGTCCAACGGCCAGCCCGAGAACAATTATAAGACCACC<br>CCTCCCGTCCTGGACAGCGACGGATCCTTCTTCTGTACTCCAGGCTGACCGTG<br>GATAAGTCCAGGTGGCAGGAGGCAACGTGTTCAGCTGCTCCGTGATGCACGAG<br>GCCCTGCACAATCACTACACCCAGAAGTCCCTGAGCCTGTCCCTGGGAAAG |
| 353 | 416E01-CDRL1<br>(IMGT) | Amino acid sequence of CDRL1<br>of 416E01 using IMGT | QGIRRW |
| 354 | 416E01-CDRL2<br>(IMGT) | Amino acid sequence of CDRL2<br>of 416E01 using IMGT | GAS |
| 355 | 416E01-CDRL3<br>(IMGT) | Amino acid sequence of CDRL3<br>of 416E01 using IMGT | QQANSFPIT |
| 356 | 416E01-CDRL1<br>(Kabat) | Amino acid sequence of CDRL1<br>of 416E01 using Kabat | RASQGIRRWLA |
| 357 | 416E01-CDRL2<br>(Kabat) | Amino acid sequence of CDRL2<br>of 416E01 using Kabat | GASSLQS |
| 358 | 416E01-CDRL3<br>(Kabat) | Amino acid sequence of CDRL3<br>of 416E01 using Kabat | QQANSFPIT |
| 359 | 416E01-Light chain variable region | Amino acid sequence of V$_L$ of 416E01 (mutations from germline are shown in bold letters) | DIQMTQSPSVSASVGDRVTITCRASQGIRRWLAWYQQKPGKAPKLLISGASSLQ<br>SGVPSRFSGSGSGTDFTLIITSLQPEDFATYYCQQANSFPITFGQGTRLEIK |
| 360 | 416E01-Light chain variable region | Nucleic acid sequence of V$_L$ of 416E01 | GACATCCAGATGACCCAGTCTCCATCTTCCGTCTGCATCTGTAGGAGACAGA<br>GTCACCATCACTTGTCGGGCAGTCAGGGTATTAGGAGGTGGTTAGCCTGTAT<br>CAGCAGAAACCAGGGAAAGCCCCTAAACTCCTGATCTCTGGTGCATCCAGTTTG<br>CAAAGTGGGGTCCCATCAAGGTTCAGCGGCAGTGGATCTGGGACAGATTTCACT<br>CTCATCATTACCAGTCTGCAGCCTGAAGATTTTGCAACTTACTATTGTCAACAGG<br>CTAACAGTTTCCCGATCACCTTCGGCCAAGGGACACGACTGGAGATCAAAC |

| SEQ ID NO: | Name | Description | Sequence |
|---|---|---|---|
| 361 | 416E01-full light chain sequence | Amino acid sequence of 416E01 light chain | DIQMTQSPSSVSASVGDRVTITCRASQGIRRWLAWYQQKPGKAPKLLISGASSLQS GVPSRFSGSGSGTDFTLIITSLQPEDFATYCQQANSFPITFGQGTRLEIKRTVAAP SVFIFPPSDEQLKSGTASVVCENNFYPREAKWWKVDNALQSGNSQESVTEQDSK DSTYSLSSTLTLSKADYEKHKVYACEVTHQGLSSPVTKSFNRGEC |
| 362 | 416E01-full light chain sequence | Nucleic add sequence of 416E01 light chain | GACATCCAGATGACCCAGTCTCCATCTTCCGTGTCTGCATCTGTAGGAGACAGA GTCACCATCACTTGTCGGGCGAGTCAGGGTATTAGGAGGTGGTTAGCCTGGTAT CAGCAGAAACCAGGGAAAGCCCCTAAACTCCTGATCTCTGGTGCATCCAGTTTG CAAAGTGGGGTCCCATCAAGGTTCAGCGGCAGTGGATCTGGGACAGATTTCACT CTCATCATTACCAGTCTGCAGCCTGAAGATTTTGCAACTTACTATTGTCAACAGG CTAACAGTTTCCGATCACCTTCGGCCAAGGGACACGACTGAGATCAAACGTA CGGTGCCGCTCCTCCGTGTTCATCTTCCCACCTTCCGACGAGCAGCTGAAGT CCGGACACCGCTTCTGTCGTGTGCCTGCTGAACAAATTTACCCCCGCGAGGCCA AGGTCAGTGGAAGGTGGACAACGCCCTGCAGTCCGGCAACTCCCAGGAATCCG TGACCGAGCAGGACTCCAAGGACAGCACCTACTCCCTGTCCTCCACCCTGACCC TGTCCAAGGCCGACTACGAGAAGCACAAGGTGTACGCCTGCGAAGTGACCCACC AGGGGCCTGTCTAGCCCCGTGACCAAGTCTTTCAACCGGGCGAGTGT |
| 363 | STIM001-CDRH1 | Amino acid sequence of CDRH1 of STIM001 using IMGT | GYTFSTFG |
| 364 | STIM001-CDRH2 | Amino acid sequence of CDRH2 of STIM001 using IMGT | ISAYNGDT |
| 365 | STIM001-CDRH3 | Amino acid sequence of CDRH3 of STIM001 using IMGT | ARSSGHYYYYGMDV |
| 366 | STIM001-Heavy chain variable region | Amino acid sequence of $V_H$ of STIM001 | QVQVVQSGAEVKKPGASVKVSCKASGYTFSTFGITWVRQAPGQGLEWMGWISAY NGDTNYAQNLQGRVIMTTDTSTSTAYMELRSLRSDDTAVYYCARSSGHYYYYGM DVWGQGTTVTVSS |
| 367 | STIM001-Heavy chain variable region | Nucleic acid sequence of $V_H$ of STIM001 | CAGGTTCAGGTGGTGCAGTCTGGAGCTGAGGTGAAGAAGCCTGGGGCCTCAGT GAAGGTCTCCTGCAAGGCTTCTGGTTACACCTTTCCACCTTTGGTTATCACCTGG GTGCGACAGGCCCCTGGACAAGGGCTTGAATGGATGGATGATCAGCGCTTA CAATGTGACACAAACTATGCCAGAATCTCCAGGGCAGAGTCATCATGACCAC AGACACATCCACGAGCGTTATTACTGTGCGAGAGACCAGTGGCCACTACTACTACGGTAT CACGGCCGTTATTACTGTGCGAGAGACCAGTGGCCACTACTACTACGGTAT GGACGTCTGGGGCCAAGGGACCACCGTCACCGTCTCCTCA |
| 368 | STIM001-full heavy chain sequence | Amino acid sequence of STIM001 heavy chain | QVQVVQSGAEVKKPGASVKVSCKASGYTFSTFGITWVRQAPGQGLEWMGWISAY NGDTNYAQNLQGRVIMTTDTSTSTAYMELRSLRSDDTAVYYCARSSGHYYYYGM DVWGQGTTVTVSSASTKGPSVFPLAPSSKSTSGGTAALGCLVKDYFPEPVTVSWN |

SEQUENCE LISTING - continued

| SEQ ID NO: | Name | Description | Sequence |
|---|---|---|---|
| | | | SGALTSGVHTFPAVLQSSGLYSLSSVVTVPSSSLGTQTYICNVNHKPSNTKVDKKVE PKSCDKTHTCPPCPAPELLGGPSVFLFPPKPKDTLMISRTPEVTCVVVDVSHEDPEV KFNWYVDGVEVHNAKTKPREEQYNSTYRVVSVLTVLHQDWLNGKEYKCKVSNKA LPAPIEKTISKAKGQPREPQVYTLPPSRDELTKNQVSLTCLVKGFYPSDIAVEWESN GQPENNYKTTPPVLDSDGSFFLYSKLIVDKSRWQQGNVFSCSVMHEALHNHYTQ KSLSLSPGK |
| 369 | STIM001-full heavy chain sequence | Nucleic acid sequence of STIM001 heavy chain | CAGGTTCAGGTTGGTGCAGTCTGGAGCTGAGGTGAAGAAGCCTGGGGCCTCAGT GAAGGTCTCCTGCAAGGCTTCTGGTTACACCTTTTCCACCTTTGGTATCACCTGG GTGCGACAGGCCCCTGACAAGGGCTTGAATGGATGGGATCAGCGCTTA CAATGTGACACAAACTATGCACAGAATCTCCAGGGCAGAGTCATCATGACCAC AGACACATCCACGAGCACAGCCTACATGGAGCTGAGGAGCCTGAGATCTGACGA CACGGCCGTTTATTACTGTGCGAGGAGACAGTTGGCCACTACTACTACTACGGTAT GGACGTCTGGGGCCAAGGGACCACGTCACCGTCTCCTCAGCCAGCCAGAGGG CCCCTCTGTGTTCCCTGGCCCTTCCAGCAAGTCCACCTCTGGCGGAACAGC CGCTCTGGGCTTCCCTGCCTCGTGAAGGACTACTTCCCCGAGCCTGTGACCGTGTCCTG GAACTCTGGCCCTGTATCTCCTCGTCCTGTGACCGCCTTCCAGCTCTCTGGG CACCCAGACCTACATCTGCAACGTGAACGCTGAACCATCCCTGCCCCCTGTCCT AAGAAGGTGAACCCAAGTCCTGGGCCGACCTTCCGTGTTCCTGTTCCCCAAAGCCAAG GCCCCTGAACTGCTGGGCGGACCCTCCGTGTTCCTGTTCCCCCAAAGCCAAG GACACCCTGATGATCTCCCGGACCCCTGAAGTGACCTGCGTGGTGGTGATGTG TCCCACAGGAGACCCTGAAGTGAAGTTCAATTGGTACGTGGACGGCGTGGAAGTG CACAACGCCAAGACCAAGCCTAGAGAGGAACAGTACAACTCCACCTACCGGGTG GTGTCCGTGCTGACCGTGCTGCACCAGGATTGGCTGAACGGCAAAGAGTACAAG TGCAAGGTGTCCAACAAGGCCCTGCCCCCATCGAAAGACCATCTCCAAG GCCAAGGGCCAGCCCCGGGAACCCCAGGTGTACACCCTGCCCCCTAGCAGGGAC GAGCTGACCAAGAACCAGGTGTCCCTGACCTGTCTCGTGAAAGGCTTTTACCCC TCCGATATCGCCGTGGAATGGGAGTCCAACGGCCAGCCTGAGAACAACTACAAG ACCACCCCCTGTCTGCTGGACTCCGACGGCTCATTCTTCCTGTACAGCAAGCTG ACAGTGGACAAGTCCCGGTGGCAGCAGGGCAACGTGTTCTCCTGCTCCGTGATG CACGAGGCCCTGCACAACCACTACACCCAGAAGTCCCTGTCCCTGAGCCCCGGC AAGTGATGA |
| 370 | STIM001-CDRL1 | Amino acid sequence of CDRL1 of STIM001 using IMGT | QSLLHSNEYNY |
| 371 | STIM001-CDRL2 | Amino acid sequence of CDRL2 of STIM001 using IMGT | LGS |
| 372 | STIM001-CDRL3 | Amino acid sequence of CDRL3 of STIM001 using IMGT | MQSLQTPLT |
| 373 | STIM001-Light chain variable region | Amino acid sequence of $V_L$ of STIM001 | DIVMTQSPLSLPVTPGEPASISCRSSQSLLHSNEYNYLDWYLQKPGQSPQLLIFLGS NRASGVPDRFSGSGSGTDFTLKITRVEAEDVGIYYCMQSLQTPLTFGGGTINEIK |

SEQUENCE LISTING

| SEQ ID NO: | Name | Description | Sequence |
|---|---|---|---|
| 374 | STIM001-Light chain variable region | Nucleic acid sequence of $V_L$ of STIM001 | GATATTGTGATGACTCAGTCTCCACTCTCCCTGCCCGTCACCCCTGGAGAGCCG GCCTCCATCTCCTGCAGGTCTAGTCAGAGCCTCCTGCATAGTAATGAATACAACT ATTTGATTGGTACCTGCAGAAGCCAGGGCAGTCTCCACAGCTCCTGATCTTT TGGGTTCTAATCGGGCCTCCGGGGTCCCTGACCAGGTTCAGTGGCAGTGATCA GGCACAGATTTTACACTGAAAATCACCAGAGTGGAGGCTGAGGATGTTGGAATT TATTACTGCATGCAATCTCTACAAACTCCGCTCACTTTCGGCGGAGGGACCAAG GTGGAGATCAAA |
| 375 | STIM001-full light chain sequence | Amino acid sequence of STIM001 light chain | DIVMTQSPLSLPVTPGEPASISCRSSQSLLHSNEYNYLDWYLQKPGQSPQLLIFLGS NRASGVPDRFSGSGSGTDFTLKITRVEAEDVGIYYCMQSLQTPLTFGGGTKVEIK RTVAAPSVFIFPPSDEQLKSGTASVVCLLNNFYPREAINQWKDNALQSGNSQESV TEQDSKDSTYSLSSTLTLSKADYEKHKVYACEVTHQGLSSPVTKSFNRGEC |
| 376 | STIM001-full light chain sequence | Nucleic acid sequence of STIM001 light chain | GATATTGTGATGACTCAGTCTCCACTCTCCCTGCCCGTCACCCCTGGAGAGCCG GCCTCCATCTCCTGCAGGTCTAGTCAGAGCCTCCTGCATAGTAATGAATACAACT ATTTGATTGGTACCTGCAGAAGCCAGGGCAGTCTCCACAGCTCCTGATCTTTT TGGGTTCTAATCGGGCCTCCGGGGTCCCTGACCAGGTTCAGTGGCAGTGATCA GGCACAGATTTTACACTGAAAATCACCAGAGTGGAGGCTGAGGATGTTGGAATT TATTACTGCATGCAATCTCTACAAACTCCGCTCACTTTCGGCGGAGGGACCAAG GTGGAGATCAAAcgtacggtggcgctccgatctgttcatcttcccaccttcgacgagcagtgaa gtccgagcaccgtcttgtcgtgcctgcaactcctaccccgagcgaggccaaggtcaaggacagcac ctactcctgtccctccaccgtgaccaagtcttcaacgggggagtgt |
| 377 | STIM002-CDRH1 | Amino acid sequence of CDRH1 of STIM002 using IMGT | GYTFTSYG |
| 378 | STIM002-CDRH2 | Amino acid sequence of CDRH2 of STIM002 using IMGT | ISAYNGNT |
| 379 | STIM002-CDRH3 | Amino acid sequence of CDRH3 of STIM002 using IMGT | ARSTYFYGSGTLYGMDV |
| 380 | STIM002-Heavy chain variable region | Amino acid sequence of $V_H$ of STIM002 | QVQLVQSGGEVKKPGASVKVSCKASGYTFTSYGFSWVRQAPGQGLEWMGWISAY NGNTNYAQKLQGRVTMTTDTSTSTAYMELRSLRSDDTAVYYCARSTYFYGSGTLY GMDVWGQGTTATTVSS |
| 381 | STIM002-Heavy chain variable region | Nucleic acid sequence of $V_H$ of STIM002 | CAGGTTCAACTGGTGCAGTCTGGAGGTGAGGTGAAGAAGCCTGGGGCCTCAGT GAAGGTCTCCTGCAAGGCTTCTGGTTACACCTTTACCAGCTATGGTTTCAGCTG |

-continued

SEQUENCE LISTING

| SEQ ID NO: | Name | Description | Sequence |
|---|---|---|---|
| | | | GGTGCGCACAGGCCCCTGGACAAGGACTAGAGTGGATGGGATGGATCAGCGCTT ACAATGTAACACAAGCTATGCACAGAAGCTCCAGGGCAGAGTCACCATGACCA CAGACACATCCACGAGCACAGCTTCATGGAGCTGAGGAGCTTGAGATCTGACG ACACGGCCGTGTATTACTGTGCAGATCTACGTATTTCTATGGTTCGGGACCC TCTACGTATGGACGTCTGGGGCCAAGGGACCACGGTCACCGTCTCCTCA |
| 382 | STIM002-full heavy chain sequence | Amino acid sequence of STIM002 heavy chain | QVQLVQSGGEVKKPGASVKVSCKASGYTFTSYGFSWVRQAPGQLEWMGWISAY NGNTNYAQKLQGRVIMTTDTSTSTAYMELRSLRSDDTAVYYCARSYFYGSGTLY GMDVWGQGTTVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKVDK KVEPKSCDKTHTCPPCPAPELLGGPSVFLFPPKPKDTLMISRTPEVTCVVDVSHED PEVKFNWYVDGVEVHNAKTKPREEQYNSTYRVVSVLTVLHQDWLNGKEYKCKVS NKALPAPIEKTISKAKGQPREPQVYTLPPSRDELTKNQVSLTCLVKGFYPSDIAVEW ESNGQPENNYKTTPPVLDSDGSFFLYSKLTVDKSRWQQGNVFSCSVMHEALHNHY TQKSLSLSPGK |
| 383 | STIM002-full heavy chain sequence | Nucleic acid sequence of STIM002 heavy chain | CAGGTTCAACTGGTGCAGTCTGGAGGTGAGGTGAAGAAGCCTGGGGCTCAGT GAAGGTCTCCTGCAAGGCTTCTGGATACACCTTTACCAGCTATGGTTTCAGCTG GGTGCGACAGGCCCCTGGACAAGGACTAGAGTGGATGGGATGGATCAGCGCTT ACAATGTAACACAAACTATGCACAGCTTCAGGGCAGAGTCACCATGACCA CAGACACATCCACGAGCACAGCTTCATGGAGCTGAGGAGCTTGAGATCTGACG ACACGGCCGTGTATTACTGTGCAGATCTACGTATTTCTATGGTTCGGGACCC TCTACGTATGGACGTCTGGGGCCAAGGGACCACGGTCACCGTCTCCTCA GCCAGCACCAAGGGCCCCTCTGTTCCCCTGGCGCCCTGCTCCTGAAGGACTACTTCCCCGAGCCT GTGACCGTGTCCTGGAACTCTGGCGCTCTGACCAGCGGAGTGCACACCTTCCCT GCTGTGCTGCAGTCCTCCGGACTCTACTCCCTGTCTCCGTCGTGACCGTCCT TCCAGCTCTCTGGGCACCCAGACCTACATCTGCAACGTGAACCACAAGCCCTCCA ACACCAAGGTGGACAAGAAGGTGGAACTCTGGGCGACCCTCCGTGTCCTGTTCC CCCCAAAGCCCAAGGACACCCTGATGATCTCCAGGACCCCTGAAGTGACCTGCG TGGTGGTGGATGTGTCCACGAGGACCCTGAAGTGAAGTTCAATTGGTACGTGG ACGGCGTGGAAGTGCACAACGCCAAGACCAAGCCTAGAGAGGAACAGTACAACT CCACCTACCGGGTGGTGTCCGTGCTGACCGTGCTGCACCAGGATTGGCTGAACG GCAAAGAGTACAAGTGCAAGGTGTCCAAACAAGGCCCTGCCCCCCATCGAAA AGACATCTCCAAGGCCAAGGGCCAGCCCCGGGAACCCCAGGTGTCCCTGACCTGTCTGTGA CCCTAGCAGGACCAGCTGACCAAGAACCAGGTGTCCCTGACCTGTCTGTGA AAGGCTTCTACCCCTCCGATATCGCCGTGGAATGGGAGTCCAACGGCCAGCCTG AGAACAACTACAAGACACCACCCCCCTGTCGACTCTGGACGTCCATTCTTCCT GTACAGCAAGCTGACAGTGGACAAGTCCCGGTGGCAGCAGGGCAACGTGTTCTC CTGCTCCGTGATGCACGAGGCCCTGCACAACCACTACACCCAGAAGTCCCTGTC CCTGAGCCCCGGCCAAGTGATGA |
| 384 | STIM002-CDRL1 | Amino acid sequence of CDRL1 of STIM002 using IMGT | QSLLHSDGYNY |

| SEQ ID NO: | Name | Description | Sequence |
|---|---|---|---|
| 385 | STIM002-CDRL2 | Amino acid sequence of CDRL2 of STIM002 using IMGT | LGS |
| 386 | STIM002-CDRL3 | Amino acid sequence of CDRL3 of STIM002 using IMGT | MQALQTPLS |
| 387 | STIM002-Light chain variable region | Amino acid sequence of V<sub>L</sub> of STIM002 | DIVMTQSPLSLPVTPGEPASISCRSSQSLLHSDGYNYLDWYLQKPGQSPQLLIYLGS TRASGFPDRFSGSGSGTDFTLKISRVEAEDVGVYYCMQALQTPLSFGQGTKLEIK |
| 388 | STIM002-Light chain variable region | Nucleic acid sequence of V<sub>L</sub> of STIM002 | GATATTGTGATGACTCAGTCTCCACTCTCCCTGCCCGTCACCCCTGGAGAGCCG GCCTCCATCTCCTGCAGGTCTAGTCAGAGCCTCCTGCATAGTGATGGATACAAC TGTTTGGATTGGTACCTGCAGAAGCCAGGGCAGTCTCCACAGCTCCTGATCTAT TTGGGTTCTACTCGGGCCTCCGGGTTCCCTGACAGGTTCAGTGGCAGTGGATCA GGCACAGATTTTACACTGAAAATCAGCAGAGTGGAGGCTGAGGATGTTGGGGTT TATTACTGCATGCAAGCTCTACAAACTCCGTGCAGTTTTGGCCAGGGGACCAAG CTGGAGATCAAA |
| 389 | STIM002-full light chain sequence | Amino acid sequence of STIM002 light chain | DIVMTQSPLSLPVTPGEPASISCRSSQSLLHSDGYNYLDWYLQKPGQSPQLLIYLGS TRASGFPDRFSGSGSGTDFTLKISRVEAEDVGVYYCMQALQTPLSFGQGTKLEIK RTVAAPSVFIFPPSDEQLKSGTASVVCLLNNFYPREAKVQWKVDNALQSGNSQESV TEQDSKDSTYSLSSTLTLSKADYEKHKVYACEVTHQGLSSPVTKSFNRGEC |
| 390 | STIM002-full light chain sequence | Nucleic acid sequence of STIM002 light chain | GATATTGTGATGACTCAGTCTCCACTCTCCCTGCCCGTCACCCCTGGAGAGCCG GCCTCCATCTCCTGCAGGTCTAGTCAGAGCCTCCTGCATAGTGATGGATACAAC TGTTTGGATTGGTACCTGCAGAAGCCAGGGCAGTCTCCACAGCTCCTGATCTAT TTGGGTTCTACTCGGGCCTCCGGGTTCCCTGACAGGTTCAGTGGCAGTGGATCA GGCACAGATTTTACACTGAAAATCAGCAGAGTGGAGGCTGAGGATGTTGGGGTT TATTACTGCATGCAAGCTCTACAAACTCCGTGCAGTTTTGGCCAGGGGACCAAG CTGGAGATCAAAcgtacggtggccgctcccagtgtgttcatcttcccaccttccgacgagcagctgaa gtccggaaccgcttctgtgtcgtgcctgctgaacaacttctaccccagggaggccaaggtgcagtggaag gtggacaacgccctgcagtccgggaactcccaggaatccgtcaccgagcaggactccaaggacagcac ctactccctgtcctccaccctgaccctgagcaaggccgactacgagaagcacaaggtgtacgcctgcga ggtgacccaccagggcctgtctagccccgtgaccaagtctttcaaccgggcgagtgt |
| 391 | STIM002-B-CDRH1 | Amino acid sequence of CDRH1 of STIM002-B using IMGT | GYTFTSYG |
| 392 | STIM002-B-CDRH2 | Amino acid sequence of CDRH2 of STIM002-B using IMGT | ISAYNGNT |
| 393 | STIM002-B-CDRH3 | Amino acid sequence of CDRH3 of STIM002-B using IMGT | ARSTYFYGSGTLYGMDV |
| 394 | STIM002-B-Heavy chain variable region | Amino acid sequence of V<sub>H</sub> of STIM002-B | QVQLVQSGGEVKKPGASVKVSCKASGYTFTSYGFSWVRQAPGQGLEWMGWISAY NGNTNYAQKLQGRVTMTTDTSTSTAYMELRSLRSDDTAVYYCARSTYFYGSGTLY GMDVWGQGTTVTVSS |

SEQUENCE LISTING

| SEQ ID NO: | Name | Description | Sequence |
|---|---|---|---|
| 395 | STIM002-B-Heavy chain variable region | Nucleic acid sequence of V$_H$ of STIM002-B | CAGGTTCAACTGGTGCAGTCTGGAGGTGAGGTGAAGAAGCCTGGGCCTCAGT GAAGGTCTCCTGCAAGGCTTCTGGTTACACCTTTACCAGCTATGGTTTCAGCTG GGTGCGACAGGCCCCTGGACAAGGACTAGAGTGGATGGGATGGATCAGCGCTT ACAATGGTAACACAAACTATGCACAGAAGCTCCAGGGCAGAGTCACCATGACCA CAGACACATCCACGAGCACAGCCTACATGGAGCTACGGAGCCTGAGATCTGACG ACACGGCCGTGTATTACTGTGCGAGATCTACGTATTTCTATGGTTCGGGGACCC TCTACGGTATGGACGTCTGGGGCCAAGGGACCACGGTCACCGTCTCCTCA |
| 396 | STIM002-B-full heavy chain sequence | Amino acid sequence of STIM002-B heavy chain | QVQLVQSGGEVKKPGASVKVSCKASGYTFTSYGFSWVRQAPGQGLEWMGWISAY NGNTNYAQKLQGRVTMTTDTSTSTAYMELRSLRSDDTAVYYCARSYFYGSGTLY GMDVWGQGTTVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKVDK KVEPKSCDKTHTCPPCPAPELLGGPSVFLFPPKPKDTLMISRTPEVTCVVVDVSHED PEVKFNWYVDGVEVHNAKTKPREEQYNSTYRWSVLTVLHQDWLNGKEYKCKVS NKALPAPIEKTISKAKGQPREPQVYTLPPSRDELTKNQVSLTCLVKGFYPSDIAVEW ESNGQPENNYKTTPPVLDSDGSFFLYSKLTVDKSRWQQGNVFSCSVMHEALHNHY TQKSLSLSPGK |
| 397 | STIM002-B-full heavy chain sequence | Nucleic acid sequence of STIM002-B heavy chain | CAGGTTCAACTGGTGCAGTCTGGAGGTGAGGTGAAGAAGCCTGGGCCTCAGT GAAGGTCTCCTGCAAGGCTTCTGGTTACACCTTTACCAGCTATGGTTTCAGCTG GGTGCGACAGGCCCCTGGACAAGGACTAGAGTGGATGGGATGGATCAGCGCTT ACAATGGTAACACAAACTATGCACAGAAGCTCCAGGGCAGAGTCACCATGACCA CAGACACATCCACGAGCACAGCCTACATGGAGCTACGGAGCCTGAGATCTGACG ACACGGCCGTGTATTACTGTGCGAGATCTACGTATTTCTATGGTTCGGGGACCC TCTACGGTATGGACGTCTGGGGCCAAGGGACCACGGTCACCGTCTCCTCAGCC GCCACCAAGGGCCCCTCTGTTCCCTGGCCCCTGCTCGTGAAGGACTACTTCCCGGAAGTCCAACTCGTG GCGGAACAGCCCGTCTGGGCTGCCCGTGTACCAGTCCTGGACTCCTCGGAGAGCAC CCGTGTCCTGGAACTCGGCCTGTACTCCCTGTCCTCCGTCAAGCCCTGCCTTCCA GCTCTCTGGGACCACCAGACCTACATCTGCAACGTGAACCACAAGCCCTCCAACAC CAAGGTGACAAGAAGTGGACAGCCAAGTCCTGCGACAAGACTCCCACCTGTCC CCCTTGTCCTGCCCCTGAAGTGCTGGGCGCACAGTCCTTCCTGTTCCCCC AAGCCCAAGGACACCCTGATGATCTCCCGGACCCCTGAAGTGAAGTTCAATTGGTACGTGGACG GGTGGATGTCCACGAGGACCCTGAAGTGAAGTTCAATTGGTACGTGGACG GCGTGGAAGTGCACAACGCCAAGACCAAGCCTAGAGAGGAACAGTACAACTCCA CCTACCGGGTGTCCGTGCTGACCGTGCTGCACCAGGATTGGCTGAACGGCA AAGAGTACAAGTGCAAGGTCTCCAACAAGGCCCTGCCTGCCCCATCGAAAGA CCATCTCCAAGGCCAAGGGCCAGCCCCGGGAACCCCAGGTGTACACACTGCCC CTAGCAGGACGAGCTGACCAAGAACCAGGTGTCCCTGACCTGTCTCGTGAAAG GCTTCTACCCCTCCGATATCGCCGTGGAATGGGAGTCCAACGGGCAGCCTGAGA ACAACTACAAGACCACCCCCTGTGCTGGACTCCGACGGCTCATTCTTCCTGTA CAGCAAGCTGACAGTGGACAAGTCCCGGTGGCAGCAGGGCAACGTGTTCTCCTG CTCCGTGATGCACGAGGCCCTGCACAACCACTACACCCAGAAGTCCCTGTCCCT GAGCCCCGGCAAGTGATGA |
| 398 | STIM002-B-CDRL1 | Amino acid sequence of CDRL1 of STIM002-B using IMGT | QSLLHSDGYNC |

SEQUENCE LISTING

| SEQ ID NO: | Name | Description | Sequence |
|---|---|---|---|
| 399 | STIM002-B-CDRL2 | Amino acid sequence of CDRL2 of STIM002-B using IMGT | LGS |
| 400 | STIM002-B-CDRL3 | Amino acid sequence of CDRL3 of STIM002-B using IMGT | MQALQTPCS |
| 401 | STIM002-B-Light chain variable region | Amino acid sequence of V<sub>L</sub> of STIM002-B | DIVMTQSPLSLPVTPGEPASISCRSSQSLLHSDGYNCLDWYLQKPGQSPQLLIYLGS TRASGFPDRFSGSGSGTDFTLKISRVEAEDVGVYYCMQALQTPCSFGQGTKLEIK |
| 402 | STIM002-B-Light chain variable region | Nucleic acid sequence of V<sub>L</sub> of STIM002-B | GATATTGTGATGACTCAGTCTCCACTCTCCCTGCCCGTCACCCCTGGAGAGCCG GCCTCCATCTCCTGCAGGTCTAGTCAGAGCCTCCTGCATAGTGATGATACAAC TGTTTGGATTGTACCTGCAGAAGCCAGGGCAGTCTCCACAGCTCCTGATCTAT TTGGGTTCTACTCGGGCCTCCGGGTTCCCTGACAGGTTCAGTGGCAGTGGATCA GGCACAGATTTTACACTGAAAATCAGCAGAGTGGAGGCTGAGGATGTTGGGGTT TATTACTGCATGCAAGCTCTACAAACTCCGTGCAGTTTTGGCCAGGGGACCAAG CTGGAGATCAAA |
| 403 | STIM002-B-full light chain sequence | Amino acid sequence of STIM002-B light chain | DIVMTQSPLSLPVTPGEPASISCRSSQSLLHSDGYNCLDWYLQKPGQSPQLLIYLGS TRASGFPDRFSGSGSGTDFTLKISRVEAEDVGVYYCMQALQTPCSFGQGTKLEIK RTVAAPSVFIFPPSDEQLKSGTASVVCLLNNFYPREAKVQWKVDNALQSGNSQESV TEQDSKDSTYSLSSTLTLSKADYEKHKVYACEVTHQGLSSPVTKSFNRGEC |
| 404 | STIM002-B-full light chain sequence | Nucleic acid sequence of STIM002-B light chain | GATATTGTGATGACTCAGTCTCCACTCTCCCTGCCCGTCACCCCTGGAGAGCCG GCCTCCATCTCCTGCAGGTCTAGTCAGAGCCTCCTGCATAGTGATGATACAAC TGTTTGGATTGTACCTGCAGAAGCCAGGGCAGTCTCCACAGCTCCTGATCTAT TTGGGTTCTACTCGGGCCTCCGGGTTCCCTGACAGGTTCAGTGGCAGTGGATCA GGCACAGATTTTACACTGAAAATCAGCAGAGTGGAGGCTGAGGATGTTGGGGTT TATTACTGCATGCAAGCTCTACAAACTCCGTGCAGTTTTGGCCAGGGGACCAAG CTGGAGATCAAAcgtacggtggctgcaccatctgtcttcatcttcccgccatctgatgagcagttgaa atctggaactgcctctgttgtgtgcctgctgaataacttctatcccagagaggccaaagtacagtggaag gtggataacgccctccaatcgggtaactcccaggagagtgtcacagagcaggacagcaaggacagcac ctacagcctcagcagcaccctgacgctgagcaaagcagactacgagaaacacaaagtctacgcctgcgaa gtgacccaccagggcctgagcagccccgtcacaaagagcttcaacaggggagagtgt |
| 405 | STIM003-CDRH1 | Amino acid sequence of CDRH1 of STIM003 using IMGT | GVTFDDYG |
| 406 | STIM003-CDRH2 | Amino acid sequence of CDRH2 of STIM003 using IMGT | INWNGGDT |
| 407 | STIM003-CDRH3 | Amino acid sequence of CDRH3 of STIM003 using IMGT | ARDFYGSGSYYHVPFDY |
| 408 | STIM003-Heavy chain variable region | Amino acid sequence of V<sub>H</sub> of STIM003 | EVQLVESGGGVVRPGGSLRLSCVASGVTFDDYGMSWVRQAPGKGLEWVSGINWN GGDTDYSDSVKGRFTISRDNAKNSLYLQMNSLRAEDTALYYCARDFYGSGSYYHV PFDYWGQGILVTVSS |

SEQUENCE LISTING -continued

| SEQ ID NO: Name | Description | Sequence |
|---|---|---|
| 409 STIM003-Heavy chain variable region | Nucleic acid sequence of V<sub>H</sub> of STIM003 | GAGGTGCAGCTGGTGGAGTCTGGGGGAGGTGTGGTACGGCCTGGGGGTCCCT GAGACTCTCCTGTGTAGCCTCTGGAGTCACCTTTGATGATTATGGCATGAGCTG GGTCCGCCAAGCTCCAGGGAAGGGCCTGGARTGGGTCTCTGTATTAATTGGA ATGGTGGCGACACAGATTATTCAGACTCTGTGAAGGGCCGATTCACCATCTCA GAGACAACGCCAAGAACTCCCTGTATCTACAAATGAATAGTCTGAGAGCCGAGG ACACGGCCTTGTATTACTGTGCGAGGGATTCTATGTTCGGGAGTTATATC ACGTTCTTTTGACTACTGGGGCCAGGGAATCCTGGTCACCGTCTCCTCA |
| 410 STIM003-full heavy chain sequence | Amino acid sequence of STIM003 heavy chain | EVQLVESGGGVVRPGGSLRLSCVASGVTFDDYGMSVINRQAPGKGLEWVSGINWN GGDTDYSDSVKGRFTISRDNAKNSLYLQMNSLRAEDTALYYCARDFYGSGSYYHV PFDYWGQGILVTVSSASTKGPSVFPLAPSSKSTSGGTAALGCLVKDYFPEPVIVSW NSGALTSGVHTFPAVLQSSGLYSLSSVVTVPSSSLGTQTYICNVNHKPSNTKVDKK VEPKSCDKTHTCPPCPAPELLGGPSVFLFPPKPKDTLMISRTPEVTCVVVDVSHEDP EVKFNWYVDGVEVHNAKTKPREEQYNSTYRVVSVLTVLHQDWLNGKEYKCKVSN KALPAPIEKTISKAKGQPREPQVYTLPPSRDELTKNQVSLTCLVKGFYPSDIAVEWE SNGQPENNYKTTPPVLDSDGSFFLYSKLTVDKSRWQQGNVFSCSVMHEALHNHYT QKSLSLSPGK |
| 411 STIM003-full heavy chain sequence | Nucleic acid sequence of STIM003 heavy chain | GAGGTGCAGCTGGTGGAGTCTGGGGGAGGTGTGGTACGGCCTGGGGGTCCCT GAGACTCTCCTGTGTAGCCTCTGGAGTCACCTTTGATGATTATGGCATGAGCTG GGTCCGCCAAGCTCCAGGGAAGGGGCTGGARTGGGTCTCTGTATTAATTGGA ATGGTGGCGACACAGATTATTCAGACTCTGTGAAGGGCCGATTCACCATCTCA GAGACAACGCCAAGAACTCCCTGTATCTACAAATGAATAGTCTGAGAGCCGAGG ACACGGCCTTGTATTACTGTGCGAGGGATTTCTATGTTCGGGAGTTATTATC ACGTTCTTTTGACTACTGGGGCCCTGTCCACCGTCTCCTCAGCCTCCACCAAGG GCCCAAGCGCCCTCTGGCCTGCCTGGTCAAGGACTACTTCCCCGAGCCTGTGA CCGTGTCCTGGAACTCTGGCGCTGTACTCCCTGTCCTCCGTGACCGTGCTCCA GCTCTCAGTGCTGGCCACCCAGACCTACATCTGCAACGTGAACCACAAGCCCTCCAACAC CAAGGTGGACAAGAAGGTGGAACCCAAGTCCTGCGACAAGACCCACACCTGTCC CCCTTGTCCTGCCCCTGAACTGCTGGGCGGACCTTCCGTGTTCCTGTTCCCCCC AAAGCCCAAGGACACCCTGATGATCTCCCGGACCCCCGAAGTGAAGTTCAATTGGTACGTGGACG GTGGATGTGTCCCACGAGGACCCTGAAGTGAAGTTCAATTGGTACGTGGACG GCGTGGAAGTGCACAACGCCAAGACCAAGCCTAGAGGAGAACAGTACAACTCCA CCTACCGGGTGGTCCGTGCTGACCGTGCTGCACCAGGATGCTGAACCGGCA AAGAGTACAAGTGCAAGGTGTCCAACAAGGCCCTGCCTGCCCCATCGAAAGA CCATCTCCAAGGCCAAGGGCCAGCCCCGGGAACCCCAGGTGTACACACTGCCC CTAGCAGGACGAGCTGACCAAGAACCAGGTGTCCCTGACCTGTCTCGTGAAAG GCTTCTACCCCTCCGATATCGCCGTGGAATGGGAGTCCAACGGCCAGCCTGAA ACAACTACAAGACCACCCCCCCTGTGCTGGACTCCGACGGCTCATTCTTCCTGTA CAGCAAGCTGACAGTGGACAAGAGTCCCGGTGGCAGCAGGGAACGGTGTTCCTG CTCCGTGATGCAGGAGGCCCTGCACAACCACTACACCCAGAAGTCCCTGTCCT GAGCCCCGGCAAGTGATGA |
| 412 STIM003-CDRL1 | Amino acid sequence of CDRL1 of STIM003 using IMGT | QSVSRSY |

| SEQ ID NO: | Name | Description | Sequence |
|---|---|---|---|
| 413 | STIM003-CDRL2 | Amino acid sequence of CDRL2 of STIM003 using IMGT | GAS |
| 414 | STIM003-CDRL3 | Amino acid sequence of CDRL3 of STIM003 using IMGT | HQYDMSPFT |
| 415 | STIM003-Light chain variable region | Amino acid sequence of V_L of STIM003 | EIVLTQSPGTLSLSPGERATLSCRASQSVSRSYLAWYQQKRGQAPRLLIYGASSRAT GIPDRFSGDGSGTDFTLSISRLEPEDFAVYYCHQYDMSPFTFGPGTKVDIK |
| 416 | STIM003-Light chain variable region | Nucleic acid sequence of V_L of STIM003 | GAAATTGTTGACGCAGTCTCCAGGGACCCTGTCTTTGTCTCCAGGGGAAAGA GCCACCCTCTCCTGCAGGGCCAGTCAGAGTGTTAGCAGAAGCTACTTAGCCTGG TACCAGCAGAAACGTGGCCAGGCTCCCAGGCTCCTCATCTATGGTGCATCAGC AGGGGCCACTGGCATCCCAGACAGGTTCAGTGGCAGTGGGTCTGGGACAGACTTC ACTCTCTCCATCAGCAGACTGGAGCCTGAAGATTTTGCAGTGTATTACTGTCACC AGTATGATATGTCACCATTCACTTTCGGCCCTGGGACCAAAGTGGATATCAAA |
| 417 | STIM003-full light chain sequence | Amino acid sequence of STIM003 light chain | EIVLTQSPGTLSLSPGERATLSCRASQSVSRSYLAWYQQKRGQAPRLLIYGASSRAT GIPDRFSGDGSGTDFTLSISRLEPEDFAVYYCHQYDMSPFTFGPGTKVDIKRTVAAP SVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 418 | STIM003-full light chain sequence | Nucleic acid sequence of STIM003 light chain | GAAATTGTTGACGCAGTCTCCAGGGACCCTGTCTTTGTCTCCAGGGGAAAGA GCCACCCTCTCCTGCAGGGCCAGTCAGAGTGTTAGCAGAAGCTACTTAGCCTGG TACCAGCAGAAACGTGGCCAGGCTCCCAGGCTCCTCATCTATGGTGCATCAGC AGGGGCCACTGGCATCCCAGACAGGTTCAGTGGCAGTGGGTCTGGGACAGACTTC ACTCTCTCCATCAGCAGACTGGAGCCTGAAGATTTTGCAGTGTATTACTGTCACC AGTATGATATGTCACCATTCACTTTCGGCCCTGGGACCAAAGTGGATATCAAAcg tacggtggcctgctccctccgtgttcatcttcccaccttccgacgagcagctgaagctggaagtggacaacgccctgcag tccggaacaactctacccccgaggccaaggtgaccaaccctgttcctccaccc tgacctgcaagggcgactcagagaacacaagtgtacgcctgcaagtgacccaccagggcctgt ctagccccgtgaccaagtctttcaaccggggcgagtgt |
| 419 | STIM004-CDRH1 | Amino acid sequence of CDRH1 of STIM004 using IMGT | GLTFDDYG |
| 420 | STIM004-CDRH2 | Amino acid sequence of CDRH2 of STIM004 using IMGT | INWNGDNT |
| 421 | STIM004-CDRH3 | Amino acid sequence of CDRH3 of STIM004 using IMGT | ARDYYGSGSYYNVPFDY |
| 422 | STIM004-Heavy chain variable region | Amino acid sequence of V_H of STIM004 | EVQLVESGGGVRPGGSLRLSCAASGLTFDDYGMSWVRQVPGKGLEWVSGINWN GDNTDYADSVKGRFTISRDNAKNSLYLQMNSLRAEDTALYYCARDYYGSGSYYNV PFDYWGQGTLVTVSS |

SEQUENCE LISTING -continued

| SEQ ID NO: | Name | Description | Sequence |
|---|---|---|---|
| 423 | STIM004-Heavy chain variable region | Nucleic acid sequence of V$_H$ of STIM004 | GAGGTGCAGCTGGTGGAGTCTGGGGGAGGTGTGGTACGGCCTGGGGGTCCCT GAGACTCTCCTGTGCAGCCTCTGGACTCACCTTTGATGATTATGGCATGAGCTG GGTCCGCCAAGTTCCAGGGAAGGGCTGGAGTGGGTCTCTGTATTAATTGGA ATGGTGATAACACAGATTATGCAGACTCTGTGAAGGGCCGATTCACCATCTCA GAGACAACGCCAAGAACTCCCTGTATCTGCAAATGAACAGTCTGAGAGCCGAGG ACACGGCCTTGTATTACTGTGCGAGGGATTACTATGGTTCGGGAGTTATTATA ACGTTCCTTTTGACTACTGGGGCCAGGGAACCCTGGTCACCGTCTCCTCA |
| 424 | STIM004-heavy chain sequence | Aminoacidsequence of STIM004 heavy chain | EVQLVESGGGVVRPGGSLRLSCAASGLTFDDYGMSWVRQVPGKGLEWVSGINWN GDNTDYADSVKGRFTISRDNAKNSLYLQMNSLRAEDTALYYCARDYYGSGSYYNV PFDYWGQGTLVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKK VEPKSCDKTHTCPPCPAPELLGGPSVFLFPPKPKDTLMISRTPEVTCVVVDVSHEDP EVKFNWYVDGVEVHNAKTKPREEQYNSTYRVVSVLTVLHQDWLNGKEYKCKVSN KALPAPIEKTISKAKGQPREPQVYTLPPSRDELTKNQVSLTCLVKGFYPSDIAVEWE SNGQPENNYKTTPPVLDSDGSFFLYSKLTVDKSRWQQGNVFSCSVMHEALHNHYT QKSLSLSPGK |
| 425 | STIM004-full heavy chain sequence | Nucleic acid sequence of STIM004 heavy chain | GAGGTGCAGCTGGTGGAGTCTGGGGGAGGTGTGGTACGGCCTGGGGGTCCCT GAGACTCTCCTGTGCAGCCTCTGGACTCACCTTTGATGATTATGGCATGAGCTG GGTCCGCCAAGTTCCAGGGAAGGGCTGGAGTGGGTCTCTGTATTAATTGGA ATGGTGATAACACAGATTATGCAGACTCTGTGAAGGGCCGATTCACCATCTCA GAGACAACGCCAAGAACTCCCTGTATCTGCAAATGAACAGTCTGAGAGCCGAGG ACACGGCCTTGTATTACTGTGCGAGGGATTACTATGGTTCGGGAGTTATTATA ACGTTCCTTTTGACTACTGGGGCCAGGGAACCCTGGTCACCGTCTCCTCAGCCA GCACCAAGGGCCCCTCTGTTCCCCCTGGCACCCTCCTCCAAGAGCACCTCTG GCGGAACAGCCGCTCTGGGCTGCCTGGTGAAGGACTACTTCCCCGAGCCTGTGA CCGTGTCCTGGAACTCTGGCGCTGTACTGCAGTCCTCAGGCCTGTACTCCCTG TCTGCAGTCCTCGGGCACCCAGACCTACATCTGCAACGTGAACCACAAGCCCTCCAACAC CAAGGTGGACAAGAAGGTGGAACCCAAGTCCTGCGACAAGACCCACACCTGTCC CCCTTGTCCTGCCCCTGAACTGCTGGGCGGACCTTCCGTGTTCCTGTTCCCCCC AAAGCCCAAGGACACCCTGATGATCTCCCGAACCCCCGAAGTGACCTGCGTGGT GGTGGATGTGTCCCACGAGGACCCTGAAGTGAAGTTCAATTGGTACGTGGACG GCGTGGAAGTGCACAACGCCAAGACCAAGCCTAGAGAGGAACAGTACAACTCCA CCTACCGGGTGGTCCGTGCTGACCGTGCTGCACCAGGATTGGCTGAACCGGCA AGAGTACAAGTGCAAGGTGTCCAACAAGGCCCTGCCTGCCCCATCGAAAAGA CCATCTCCAAGGCCAAGGGCCAGCCCCGGGAACCCCAGGTGTACACACTGCCC CTAGCAGGGACGAGCTGACCAAGAACCAGGTGTCCCTGACCTGTCTGGAAAG GCTTCTACCCCTCCGATATCGCCGTGGAATGGGAGTCCAACGGCCAGCCTGAGA ACAACTACAAGACCACCCCCGTGCTGGACTCCGACGGCTCATTCTTCCTGTA CAGCAAGCTGACAGTGGACAAGAGTCCCGGTGGCAGCAGGGAACAGTGTTCTCTG CTCCGTGATGCAGGAGGCCCTGCACAACCACTACACCCAGAAGTCCCTGTCCT GAGCCCCGGCAAGTGATGA |
| 426 | STIM004-CDRL1 | Amino acid sequence of CDRL1 of STIM004 using IMGT | QSVSSSY |

SEQUENCE LISTING

| SEQ ID NO: | Name | Description | Sequence |
|---|---|---|---|
| 427 | STIM004-CDRL2 | Amino acid sequence of CDRL2 of STIM004 using IMGT | GAS |
| 428 | STIM004-CDRL3 | Amino acid sequence of CDRL3 of STIM004 using IMGT | QQYGSSPF |
| 429 | STIM004-Corrected light chain variable region | Amino acid sequence of corrected VL of STIM004 | EIVLTQSPGTLSLSPGERATLSCRASQSVSSSYLAWYQQKPGQAPRLLIYGASSRAT GIPDRFSGSGSGTDFTLTIRRLEPEDFAVYYCQQYGSSPFFGPGTKVDIK |
| 430 | STIM004-Corrected light chain variable region | Nucleic acid sequence of corrected VL of STIM004 | GAAATTGTGTTGACGCAGTCTCCAGGCACCCTGTCTTTGTCTCCAGGGGAAAGA GCCACCCTCTCCTGCAGGGCCAGTCAGAGTGTTAGCAGCAGCTACTTAGCCTGG TACCAGCAGAAACCTGGCCAGGCTCCCAGGCTCCTCATATATGGTGCATCCAGC AGGGCCACTGGCATCCCAGACAGGTTCAGTGGCAGTGGGTCTGGGACAGACTTC ACTCTCACCATCAGAAGACTGGAGCCTGAAGATTTTGCAGTGTATTACTGTCAG CAGTATGGTAGTTCACCATTCTTCGGCCCTGGGACCAAAGTGGATATCAAA |
| 431 | STIM004-Light chain variable region | Nucleic acid sequence of VL of STIM004 | GAAATTGTGTTGACGCAGTCTCCAGGCACCCTGTCTTTGTCTCCAGGGGAAAGA GCCACCCTCTCCTGCAGGGCCAGTCAGAGTGTTAGCAGCAGCTACTTAGCCTGG TACCAGCAGAAACCTGGCCAGGCTCCCAGGCTCCTCATATATGGTGCATCCAGC AGGGCCACTGGCATCCCAGACAGGTTCAGTGGGTCTGGGACAGACTTC ACTCTCACCATCAGAAGACTGGAGCCTGAAGATTTTGCAGTGTATTACTGTCAG CAGTATGGTAGTTCACCATTCACTTCGGCCCTGGGACCAAAGTGGATATCAAA |
| 432 | STIM004-full corrected light chain sequence | Amino acid sequence of STIM004 light chain | EIVLTQSPGTLSLSPGERATLSCRASQSVSSSYLAWYQQKPGQAPRLLIYGASSRAT GIPDRFSGSGSGTDFTLTIRRLEPEDFAVYYCQQYGSSPFFGPGTKVDIKRTVAAPS VFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 433 | STIM004-full corrected light chain sequence | Nucleic acid sequence of corrected STIM004 light chain | GAAATTGTGTTGACGCAGTCTCCAGGCACCCTGTCTTTGTCTCCAGGGGAAAGA GCCACCCTCTCCTGCAGGGCCAGTCAGAGTGTTAGCAGCAGCTACTTAGCCTGG TACCAGCAGAAACCTGGCCAGGCTCCCAGGCTCCTCATATATGGTGCATCCAGC AGGGCCACTGGCATCCCAGACAGGTTCAGTGGCAGTGGGTCTGGGACAGACTTC ACTCTCACCATCAGAAGACTGGAGCCTGAAGATTTTGCAGTGTATTACTGTCAG CAGTATGGTAGTTCACCATTCTTCGGCCCTGGGACCAAAGTGGATATCAAAcgta cggtggccgctccccgtcttcatcttcccaccctcgacgagcagctgaaggtgcaactcccctgcaact ggtatcgtgtgctgctgaacaacttctaccccgaggccaaggtcccaggactcccaggtgacacgccagat gaccccggtgaccaagtctttcaaccgggcagtgt |
| 434 | STIM004-full light chain sequence | Nucleic acid sequence of STIM004 light chain | GAAATTGTGTTGACGCAGTCTCCAGGCACCCTGTCTTTGTCTCCAGGGGAAAGA GCCACCCTCTCCTGCAGGGCCAGTCAGAGTGTTAGCAGCAGCTACTTAGCCTGG TACCAGCAGAAACCTGGCCAGGCTCCCAGGCTCCTCATATATGGTGCATCCAGC AGGGCCACTGGCATCCCAGACAGGTTCAGTGGCAGTGGGTCTGGGACAGACTTC ACTCTCACCATCAGAAGACTGGAGCCTGAAGATTTTGCAGTGTATTACTGTCAG CAGTATGGTAGTTCACCATTCACTTCGGCCCTGGGACCAAAGTGGATATCAAAcg |

SEQUENCE LISTING

| SEQ ID NO: | Name | Description | Sequence |
|---|---|---|---|
| | | | tacgtggcgctcctccgtcatcttccacttccgcgagcagtgaagtgaagccgcaccgcttctgtc gtgtgcctgctgaacaactctaccccgcgagccaggtcgcaaggtgcaggacaaggtggacaacgcctgcag tccgcaactcccaggaatccgtgaccgagcagcaggactccaaggacgcaggacaccctactccctgtcctccaccc tgacctgtccaaggcgactacgagaagacaagtgtacgcctcgaagtgacccaaccaggcctgt ctagccccgtgaccaagtcttccaacggcgagtgt |
| 435 | STIM005-CDRH1 | Amino acid sequence of CDRH1 of STIM005 using IMGT | GYTFNSYG |
| 436 | STIM005-CDRH2 | Amino acid sequence of CDRH2 of STIM005 using IMGT | ISVHNGNT |
| 437 | STIM005-CDRH3 | Amino acid sequence of CDRH3 of STIM005 using IMGT | ARAGYDILTDFSDAFDI |
| 438 | STIM005-Heavy chain variable region | Amino acid sequence of V$_H$ of STIM005 | QVQLVQSGAEVKKPGASVKVSCKASGYTFNSYGIIWVRQAPGQGLEWMGWISVH NGNTNCAQKLQGRVTMTTDTSTSTAYMELRSCRTDDTAVYYCARAGYDILTDFSD AFDIWGHGTMVTVSS |
| 439 | STIM005-Heavy chain variable region | Nucleic acid sequence of V$_H$ of STIM005 | CAGGTTCAGTTGGTGCAGTCTGGAGCTGAGGTGAAGAAGCCTGGGGCCTCAGT GAAGGTCTCCTGCAAGGCTTCTGGTTACACCTTTAATAGTTATGGTATCATCTG GGTGCGACAGGCCCCTGGACAAGGGCTTGAGTGGATGGGATGGATCAGCGTTC ACAATGTAACACAAACTGTGCACAGAAGCTCCAGGTGAGTCACCATGACCA CAGACACATCCACGAGCACAGCTACATGGAGCCTGAGGAGCCTGAGAACTGACG ACACGGCCGTGTATTACTGTGCGAGAGCGGGTTACGATATTTTGACTGATTTT CCGATCTTTGATATCTGGGGCCACGGGACAATGTCACCGTCTCTTCA |
| 440 | STIM005-full heavy chain sequence | Amino acid sequence of STIM005 heavy chain | QVQLVQSGAEVKKPGASVKVSCKASGYTFNSYGIIWVRQAPGQGLEWMGWISVH NGNTNCAQKLQGRVTMTTDTSTSTAYMELRSLRTDDTAVYYCARAGYDILTDFSD AFDIWGHGTMVTVSSASTKGPSVFPIAPSSKSTSGGTAALGCLVKDYFPEPVTVSW NSGALTSGVHTFPAVLQSSGLYSLSSVVTVPSSSLGTQTYICNVNHKPSNTKVDKK VEPKSCDKTHTCPPCPAPELLGGPSVFLFPPKPKDTLMISRTPEVTCVVVDVSHEDP EVKFNWYVDGVEVHNAKTKPREEQYNSTYRVVSVLTVLHQDWLNGKEYKCKVSN KALPAPIEKTISKAKGQPREPQVYTLPPSRDELTKNQVSLTCLVKGFYPSDIAVEWE SNGQPENNYKTTPPVLDSDGSFFLYSKLTVDKSRWQQGNVFSCSVMHEALHNHYT QKSLSLSPGK |
| 441 | STIM005-full heavy chain sequence | Nucleic acid sequence of STIM005 heavy chain | CAGGTTCAGTTGGTGCAGTCTGGAGCTGAGGTGAAGAAGCCTGGGGCCTCAGT GAAGGTCTCCTGCAAGGCTTCTGGTTACACCTTTAATAGTTATGGTATCATCTG GGTGCGACAGGCCCCTGGACAAGGGCTTGAGTGGATGGGATGGATCAGCGTTC ACAATGGTAACACAAACTGTGCACAGAAGCTCCAGGTGAGTCACCATGACCA CAGACACATCCACGAGCACAGCCTACATGGAGCTGAGGAGCCTGAGAACTGACG ACACGGCCGTGTATTACTGTGCGAGAGCGGGTTACGATATTTTGACTGATTTT CCGATCTTTGATATCTGGGGCCACGGGACAATGGTCACCGTCTCTTCA GCCAGCACCAAGGGCCCCTCTGTTCCCTCTGGCCCCTCCAGCAAGTCACC TCTGGCGGACACAGCCGCCCTCGGCTGCCTGGTCAAGGACTACTTCCCCGAGCCT GTGACCGTGTCCTGGAACTCTGGCGCTCTGACCAGCGGAGTGCACACCTTCCCT |

SEQUENCE LISTING -continued

| SEQ ID NO: | Name | Description | Sequence |
|---|---|---|---|
| | | | GCTGTGCTGACTCCTCCGGCCTCCTCCGTCTCCTCGTCGTGACCGTGCCT |
| | | | TCCAGCTCTCGGGACCCAGAGTCTGGACCACCTGAACGTGAACCACCAGACCCCTCCA |
| | | | ACACCAAGGTGGACAAGAAGTGGAACTGCCAAGTCTGCCACAAGACCCACACCT |
| | | | GTCCCCCTGTCCTGCCCTGAACTGCTGGGCGACCTTCCGTGTTCCTGTTCC |
| | | | CCCAAAGCCCAAGGACACCCCTGATGATCTCCCGGACCCCGAAGTGACCTGCG |
| | | | TGGTGGTGGATGTGTCCCACGAGGACCCTGAAGTGAAGTTCAATTGGTACGTGG |
| | | | ACGGCGTGGAAGTGCACAACGCCAAGACCAAGCCTAGAGAGGAACAGTACAACT |
| | | | CCACTTACCGTGTGGTGTCCGTGCTGACCGTGCTGCACCAGGATTGGCTGAACG |
| | | | GCAAGGAGTACAAGTGCAAGTGTCCAACAAGGCCCTGCCTGCCCATCGAAA |
| | | | AGACCATCTCCAAGGCCAAGGGCCAGCCCCGGGAACCCCAGGTGTACACACTGC |
| | | | CCCCTAGCAGGGACGAGCTGACCAAGAACCAGGTGTCCCTGACCTGTCTCGTGA |
| | | | AGGGCTTCTACCCCTCCGATATCGCCGTGGAATGGGAGTCCAACGGCCAGCCTG |
| | | | AGAACAACTACAAGACCACCCCCCTGTCTGGACTCCGACGGCTCATTCTTCCT |
| | | | GTACAGCAAGCTGACAGTGGACAAGAGCCGGTGGCAGCAGGGCAACGTGTTCTC |
| | | | CTGCTCCGTGATGCACGAGGCCCTGCACAACCACTACACCCAGAAGTCTCCGTC |
| | | | CCTGAGCCCCGGCAAGTGATGA |
| 442 | STIM005-CDRL1 | Amino acid sequence of CDRL1 of STIM005 using IMGT | QNINNF |
| 443 | STIM005-CDRL2 | Amino acid sequence of CDRL2 of STIM005 using IMGT | AAS |
| 444 | STIM005-CDRL3 | Amino acid sequence of CDRL3 of STIM005 using IMGT | QQSYGIPW |
| 445 | STIM005-Light chain variable region | Amino acid sequence of V$_L$ of STIM005 | DIQMTQSPSSLSASVGDRVTITCRASQNINNFLNWYQQKEGKGPKLLIYAASSLQR GIPSTFSGSGSGTDFTLTISSLQPEDFATYICQQSYGIPWVGQGTKVEIK |
| 446 | STIM005-Light chain variable region | Nucleic acid sequence of V$_L$ of STIM005 | GACATCCAGATGACCCAGTCTCCATCCTCCCTGTCTGCATCTGTAGGAGACAGA GTCACCATCACTTGCCGGGCAAGTCAGAACATTAATAACTTTTTAATTGTATC AGCAGAAAGAAGGGAAAGGCCCAAGCTCCTGATCTATGCAGCATCCAGTTTGC AAAGAGGGATACCATCAAGCTTCAGTGGCAGTGGATCTGGGACAGACTTCACTC TACCATCAGCAGTCTGCAACCTGAAGATTTTGCAACTTACATCTGTCAACAGAG CTACGGTATCCCGTGGTCGGCCAAGGGACCAAGGTGGAAATCAAA |
| 447 | STIM005-full light chain sequence | Amino acid sequence of STIM005 light chain | DIQMTQSPSSLSASVGDRVTITCRASQNINNFLNWYQQKEGKGPKLLIYAASSLQR GIPSTFSGSGSGTDFILTISSLQPEDFATYICQQSYGIPWVGQGTKVEIK RTVAAPSVFIFPPSDEQLKSGTASVVCLLNNFYPREAKVQWKVDNALQSGNSQESV TEQDSKDSTYSLSSTLTLSKADYEKHKVYACEVTHQGLSSPVTKSFNRGEC |
| 448 | STIM005-full light chain sequence | Nucleic acid sequence of STIM005 light chain | GACATCCAGATGACCCAGTCTCCATCCTCCCTGTCTGCATCTGTAGGAGACAGA GTCACCATCACTTGCCGGGCAAGTCAGAACATTAATAACTTTTTAATTGTATC AGCAGAAAGAAGGGAAAGGCCCAAGCTCCTGATCTATGCAGCATCCAGTTTGC AAAGAGGGATACCATCAAGCTTCAGTGGCAGTGGATCTGGGACAGACTTCACTC TACCATCAGCAGTCTGCAACCTGAAGATTTTGCAACTTACATCTGTCAACAGAG CTACGGTATCCCGTGGTCGGCCAAGGGACCAAGGTGGAAATCAAAcgtacggtgg |

| SEQ ID NO: | Name | Description | Sequence |
|---|---|---|---|
| | | | ccgctccctccgtgtcattcctccacctccgacgagcagctgaagtccggcaccgcttctgtcgtgcct<br>gctgaacaactctctacccccgagcgacgaggccaaggtcgaggtggacaacgcctgcagtccggca<br>actcccaggaatccgtgaccgagcaggactccaaggacagcacctactccctgtcctccaccctgacct<br>gtccaaggccgactacgaagcacaaggtgtacgcctgcgaagtgacccaccagggcctgtctagcc<br>cgtgaccaagtcttttcaaccgggcgagtgt |
| 449 | STIM006-CDRH1 | Amino acid sequence of CDRH1 of STIM006 using IMGT | GFTFSDYF |
| 450 | STIM006-CDRH2 | Amino acid sequence of CDRH2 of STIM006 using IMGT | ISSSGSTI |
| 451 | STIM006-CDRH3 | Amino acid sequence of CDRH3 of STIM006 using IMGT | ARDHYDGSGIYPLYYYGLDV |
| 452 | STIM006-Heavy chain variable region | Amino acid sequence of V$_H$ of STIM006 | QVQLVESGGGLVKPGGSLRLSCAASGFTFSDYFMSWIRQAPGKGLEWISYISSSGS<br>TIYYADSVRGRFTISRDNAKYSLYLQMNSLRSEDTAVYYCARDHYDGSGIYPLYYY<br>GLDVWGQGTTVTVSS |
| 453 | STIM006-Heavy chain variable region | Nucleic acid sequence of V$_H$ of STIM006 | CAGGTGCAGCTGGTGGAGTCTGGGGGAGGCTTGGTCAAGCCTGGAGGGTCCCT<br>GAGACTCTCCTGTGCAGCCTCTGGATTCACCTTCAGTGACTACTTCATGAGCTG<br>GATCCGCCAGGCCCCAGGGAAGGGGCTGGAGTGGATTTCATACATTAGTTCTAG<br>TGGTAGTACCATATACTACGCAGACTCTGTGAAGGGCCGATTCACCATCTCCAG<br>GGACAACGCCAAGTACTCACTGTATCTGCAAATGAACAGCCTGAGATCCGAGGA<br>CACGGCCGTGTATTACTGTGCGAGAGATCACTACGATGGTTCGGGGATTTATCC<br>CCTCTACTACTATTACGGTTTGGACGTCTGGGGCCAAGGGACCACGGTCACCGT<br>CTCCTCA |
| 454 | STIM006-full heavy chain sequence | Amino acid sequence of STIM006 heavy chain | QVQLVESGGGLVKPGGSLRLSCAASGFTFSDYFMSWIRQAPGKGLEWISYISSSGS<br>TIYYADSVRGRFTSRDNAKYSLYLQMNSLRSEDTAVYYCARDHYDGSGIYPLYYY<br>GLDVWGQGTTVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKK<br>VEPKSCDKTHTCPPCPAPELLGGPSVFLFPPKPKDTLMISRTPEVTCVVVDVSHEDP<br>EVKFNWYVDGVEVHNAKTKPREEQYNSTYRVVSVLTVLHQDWLNGKEYKCKVSN<br>KALPAPIEKTISKAKGQPREPQVYTLPPSRDELTKNQVSLTCLVKGFYPSDIAVEWE<br>SNGQPENNYKTTPPVLDSDGSFFLYSKLIVDKSRWQQGNVFSCSVMHEALHNHYT<br>QKSLSLSPGK |
| 455 | STIM006-full heavy chain sequence | Nucleic acid sequence of STIM006 heavy chain | CAGGTGCAGCTGGTGGAGTCTGGGGGAGGCTTGGTCAAGCCTGGAGGGTCCCT<br>GAGACTCTCCTGTGCAGCCTCTGGATTCACCTTCAGTGACTACTTCATGAGCTG<br>GATCCGCCAGGCCCCAGGGAAGGGGCTGGAGTGGATTTCATACATTAGTTCTAG<br>TGGTAGTACCATATACTACGCAGACTCTGTGAAGGGCCGATTCACCATCTCCAG<br>GGACAACGCCAAGTACTCACTGTATCTGCAAATGAACAGCCTGAGATCCGAGGA<br>CACGGCCGTGTATTACTGTGCGAGAGATCACTACGATGGTTCGGGGATTTATCC<br>CCTCTACTACTATTACGGTTTGGACGTCTGGGGCCAAGGGACCACGGTCACCGT<br>CTCCTCAGCCAGCACCAAGGGCCCATCGGTCTTCCCCCTGGCGCCCTGCTCCAA<br>GTCCACCTCTGGCGGACAGCGGCCCTGGGCTGCCTGGTCAAGGACTACTTCCC |

| SEQ ID NO: | Name | Description | Sequence |
|---|---|---|---|
| | | | CGAGCCTGTGACCGTCTCCTGGAACTCTGGCGCTCTGACCAGCGGAGTGCACAC<br>CTTCCCTGCTGTGCTGCAGTCTCCGGCACCCAGACCTACATCTGCAACGTGAACCACAA<br>CGTGCCTTCCAGCTCTCTGGGCACCCAGACCTACATCTGCAACGTGAACCACAA<br>GCCCTCCAACACCAAGGTGGACAAGAGGTGGAACCCAAGTCCTGCACAAGAC<br>CCACACCTGCTCCCCCTGTCCTCCAAAGCACACCTGAACTGTGGGACCACCCCTGTGTT<br>CCTGTTCCCCCCAAAGCCAAGGACACCCTGATGATCTCCAGGACCCCTGAAGT<br>GACCTGCGTGGTGGTGGATGTGTCCACGAGGACCCTGAAGTTCAATTG<br>GTACGTGGACGGCGTGGAAGTGCACAACGCCAAGACCAAGCCTAGAGAGGAAC<br>AGTACAACTCCACCTACCGGGTGGTGTCCGTGCTGACCGTGCTGCACCAGGATT<br>GGCTGAACGGCAAAGAGTACAAGTGCAAGGTGTCCAACAAGGCCCTGCCTGCCC<br>CCATCGAAAAGACCATCTCCAAGGCCAAGGGCCAGCCCCGGGAACCCCAGGTGT<br>ACACACTGCCCCCTAGCCAGGAGGAGATGACCAAGAACCAGGTGTCCCTGACCT<br>GTCTCGTGAAAGGCTTCTACCCCTCCGATATCGCCGTGGAATGGGAGTCCAACG<br>GCCAGCCTGAGAACAACTACAAGACACACCCCCCGTGCTGGACTCCGACGGCT<br>CATTCTTCCTGTACAGCAAGCTGACAGTGGACAAGTCCCGGTGGCAGCAGGGCA<br>ACGTGTTCTCCTGCTCCGTGATGCACGAGGCCCTGCACAACCACTACACCCAGA<br>AGTCCCTGTCCCTGAGCCCCGGCAAGTGATGA |
| 456 | STIM006-CDRL1 | Amino acid sequence of CDRL1 of STIM006 using IMGT | QSLLHSNGYNY |
| 457 | STIM006-CDRL2 | Amino acid sequence of CDRL2 of STIM006 using IMGT | LGS |
| 458 | STIM006-CDRL3 | Amino acid sequence of CDRL3 of STIM006 using IMGT | MQALQTPRS |
| 459 | STIM006-Light chain variable region | Amino acid sequence of V_L of STIM006 | IVMTQSPLSLPVTPGEPASISCRSSQSLLHSNGYNYLDYYLQKPGQSPQLLIYLGSY<br>RASGVPDRFSGSGSGTDFTLKISRVEAEDVGVYYCMQALQTPRSFGQGTTLEIK |
| 460 | STIM006-Light chain variable region | Nucleic acid sequence of V_L of STIM006 | ATTGTGATGACTCAGTCTCCACTCTCCCTGCCCGTCACCCCTGGAGAGCCGGCC<br>TCCATCTCCTGCAGGTCTAGTCAGAGCCTCCTGCATAGTAATGGATACAACTATT<br>TGGATTATTACCTGCAGAAGCCAGGGCAGTCTCCACAGCTCCTGATCTATTTGG<br>GTTCTTATCGGGCCTCCGGGGTCCCTGACAGGTTCAGTGCAGTGGATCAGGCA<br>CAGATTTTACACTGAAAATCAGCAGAGTGGAGGCTGAGGATGTTGGGGTTTATT<br>ACTGCATGCAAGCTCTACAAACTCCTCGCAGTTTTGGCCAGGGGACCACGCTGG<br>AGATCAAA |
| 461 | STIM006-full light chain sequence | Amino acid sequence of STIM006 light chain | IVMTQSPLSLPVTPGEPASISCRSSQSLLHSNGYNYLDYYLQKPGQSPQLLIYLGSY<br>RASGVPDRFSGSGSGTDFTLKISRVEAEDVGVYYCMQALQTPRSFGQGTTLEIKRT<br>VAAPSVFIFPPSDEQLKSGTASVVCLLNNFYPREAKVQWKVDNALQSGNSQESVTE<br>QDSKDSTYSLSSTLTLSKADYEKHKVYACEVTHQGLSSPVTKSFNRGEC |
| 462 | STIM006-full light chain sequence | Nucleic acid sequence of STIM006 light chain | ATTGTGATGACTCAGTCTCCACTCTCCCTGCCCGTCACCCCTGGAGAGCCGGCC<br>TCCATCTCCTGCAGGTCTAGTCAGAGCCTCCTGCATAGTAATGGATACAACTATT<br>TGGATTATTACCTGCAGAAGCCAGGGCAGTCTCCACAGCTCCTGATCTATTTGG<br>GTTCTTATCGGGCCTCCGGGGTCCCTGACAGGTTCAGTGCAGTGGATCAGGCA |

-continued

SEQUENCE LISTING

| SEQ ID NO: | Name | Description | Sequence |
|---|---|---|---|
| | | | CAGATTTACTCTGAAAATCAGCAGAGTGGAGGCTGAGGATGTTGGGGTTTATT ACTGCATGCAAGCTCTACAAACTCCTCGCAGTTTTGCCTCAGGGGACCACGCTGG AGATCAAcgtacggtggccgctccctccgtgttcatcttcccacctcgacgagcagctgaagtccg gaccgcttctgtgtgtccggcaactccaggaatccgtgaccgagcagcagaaggcccaaggtcatg caacgccctcgagtccggcaactccaggaatccgtgaccgagcagcagaaggacaagaaccactc cctgtctccaccgtccaaggccgacgacgaaggaagcaagacagtacgccttgcgaagtgacc caccagggcctgtctagcccgtgaccaagtcttcaacggggcgagtgt |
| 463 | STIM007-CDRH1 | Amino acid sequence of CDRH1 of STIM007 using IMGT | GFSLSTTGVG |
| 464 | STIM007-CDRH2 | Amino acid sequence of CDRH2 of STIM007 using IMGT | IYWDDDK |
| 465 | STIM007-CDRH3 | Amino acid sequence of CDRH3 of STIM007 using IMGT | THGYGSASYYHYGMDV |
| 466 | STIM007-Heavy chain variable region | Amino acid sequence of V$_H$ of STIM007 | QITLKESGPTLVKPTQTLTLTCTFSGFSLSTTGVGVGWIRQPPGKALEWLAVIYWD DDKRYSPSLKSRLTITKDTSKNQVVLTMTNMDPVDTATYFCTHGYGSASYYHYGM DVWGQGTTVTVSS |
| 467 | STIM007-Heavy chain variable region | Nucleic acid sequence of V$_H$ of STIM007 | CAGATCACCCTGAAGGAGTCTGGTCCTACCCTGGTGAAACCCACACAGACCCTC ACGCTGACCTGCACCTTCTCAGGGTTCTCACTCAGCACTACTGGAGTGGGTGTG GGCTGGATCCGTCAGCCCCTCAGGGAAAGGCCCTGGAGCTTGCAGTCATTTAT TGGGATGATGATAAGCGCTACAGCCCATCTCTGAAGAGCAGACTGACCATCACC AAGGACACCTCCAAAAACCAGGTGGTCCTTACAATGACCAATGACCCTGTG GACACAGCCACCTATTTCTGTACACAGGATAGGTTCGGCGAGTTATTACCACT ACGGTATGGACGTCTGGGGCCAAGGGACCACGGTCACCGTCTCCTCA |
| 468 | STIM007-full heavy chain | Amino acid sequence of STIM007 heavy chain | QITLKESGPTLVKPTQTLTLTCTFSGFSLSTTGVGVGWIRQPPGKALEWLAVIYWD DDKRYSPSLKSRLTITKDTSKNQVVLTMTNMDPVDTATYFCTHGYGSASYYHYGM DVWGQGTTVTVSSASTKGPSVFPLAPSSKSTSGGTAALGCLVKDYFPEPVTVSWN SGALTSGVHTFPAVLQSSGLYSLSSVVTVPSSSLGTQTYICNVNHKPSNTKVDKKWE PKSCDKTHTCPPCPAPELLGGPSVFLFPPKPKDTLMISRTPEVTCVVVDVSHEDPEV KFNWYVDGVEVHNAKTKPREEQYNSTYRVVSVLTVLHQDWLNGKEYKCKVSNKA LPAPIEKTISKAKGQPREPQVYTLPPSRDELTKNQVSLTCLVKGFYPSDIAVEWESN GQPENNYKTTPPVLDSDGSFFLYSKLTVDKSRWQQGNVFSCSVMHEALHNHYTQ KSLSLSPGK |
| 469 | STIM007-full heavy chain | Nucleic acid sequence of STIM007 heavy chain sequence | CAGATCACCCTGAAGGAGTCTGGTCCTACCCTGGTGAAACCCACACAGACCCTC ACGCTGACCTGCACCTTCTCTGGGTTCTCACTCAGCACTACTGGAGTGGGTGTG GGCTGGATCCGTCAGCCCCCAGGGAAAGGCCCTGGAGTTGCAGTCATTTAT TGGGATGATGATAAGCGCTACAGCCCATCTCTGAAGAGCAGACTGACCATCACC AAGGACACCTCCAAAAACCAGGTGGTCCTTACAATGACCAATGACCCTGTG GACACAGCCACCTATTTCTGTACACAGGATAGGTTCGGCGAGTTATTACCACT ACGGTATGGACGTCTGGGGCCAAGGGACCACGGTCACCGTCTCCTCA GCCAGCACCAAGGGCCCCTCTGTTCCCCTGGCCCCTTCCAGCAGTCCACC |

SEQUENCE LISTING -continued

| SEQ ID NO: | Name | Description | Sequence |
|---|---|---|---|
| | | | TCTGCGGAACAGCCGCTCTGGCTGCCTCTGAAGGACTACTTCCCGAGCCT |
| | | | GTGACCGTGTCCTGGAACTCTGGCGCTGTACTCCTGTCCTGACACCTTCCCT |
| | | | GCTGTGCTGCAGTCCTCCGGACTCTACTCCCTGTCCTCCGTGACCGTGCCT |
| | | | TCCAGCTCTCTGGGCACCCAGACCTACATTTGCAACGTGAACCACAAGCCCTCCA |
| | | | ACACCAAGGTGGACAAGAAGTGGAACCTCTGCGACAAGACCCACCT |
| | | | GTCCCCCTGTCCTGCCCCAGACACCCTGAACTGTGGGCGACCTTCCTGTTCC |
| | | | CCCAAAGCCCAAGACACACCCTGATGATCTCCCGGACCCCCGAAGTGACCTGG |
| | | | TGGTGGATGTGTCCCACGAGGACCCAAGACCAAGCCTAGAGAGAACAGTACAACT |
| | | | ACGGCTGGAAGTGCACAACGCCAAGACCAAGCCTAGAGAGAACAGTACAACT |
| | | | CCACCTACCGGGTGGTGTCCGTGCTGACCGTGCTGCACCAGGATTGGCTGAACG |
| | | | GCAAAGAGTACAAGTGCAAGGTGTCCAACAAGGCCCTGCCCCCATCGAAAA |
| | | | AGACCATCTCCAAGGCCAAGGCCAGCCCGGAACCCCAGGTGTACCTGTCTCTGA |
| | | | CCCCTAGCAGGGAGGAGATGACCAAGAACCAGGTGTCCCTGACCTGTCTGA |
| | | | AAGGCTTCTACCCCTCCGATATCGCCGTGGAATGGGAGTCCAACGGCCAGCTG |
| | | | AGAACAACTACAAGACAACCCCTCCTGTGCTGGACTCCGACGGCTCATTCTTCCT |
| | | | GTACAGCAAGCTGACAGTGGACAAGTCCCGGTGGCAGCAGGGCAACGTGTTCTC |
| | | | CTGCTCCGTGATGCACGAGGCCCTGCACAACCACTACACCCAGAAGTCCCTGTC |
| | | | CCTGAGCCCCGGCAAGTGATGA |
| 470 | STIM007-CDRL1 | Amino acid sequence of CDRL1 of STIM007 using IMGT | QSVTNY |
| 471 | STIM007-CDRL2 | Amino acid sequence of CDRL2 of STIM007 using IMGT | DAS |
| 472 | STIM007-CDRL3 | Amino acid sequence of CDRL3 of STIM007 using IMGT | QHRSNWPLT |
| 473 | STIM007-Light chain variable region | Amino acid sequence of V$_L$ of STIM007 | EIVLTQSPATLSLSPGERATLSCRASQSVTNYLAWHQQKPGQAPRLLIYDASNRAT GIPARFSGSGSGTDFTLTISSLEPEDFAVYYCQHRSNWPLTFGGGTKVEIK |
| 474 | STIM007-Light chain variable region | Nucleic acid sequence of V$_L$ of STIM007 | GAAATTGTATTGACACAGTCTCCAGCCACCCTGTCTTTGTCTCCAGGGGAAAGA GCCACCCTCTCCTGCAGGGCCAGTCAGAGTGTTACCAACTACTTAGCCTGGCAC CAACAGAAACCTGGCCAGGCTCCCAGGCTCCTCATCTATGATGCATCCAACAGG GCCACTGGCATCCCAGCCAGGTTCAGTGGCAGTGGGTCTGGGACAGACTTCACT CTCACCATCAGCAGCCTCCAGCCTGAAGATTTTGCAGTTTATTACTGTCAGCACC GTAGCAACTGGCCTCTCACTTTCGGCGGAGGGACCAAGGTGGAGATCAAAC |
| 475 | STIM007-full light chain sequence | Amino acid sequence of STIM007 light chain | EIVLTQSPATLSLSPGERATLSCRASQSVTNYLAWHQQKPGQAPRLLIYDASNRAT GIPARFSGSGSGTDFTLTISSLEPEDFAVYYCQHRSNWPLTFGGGTKVEIKRTVAAP SVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 476 | STIM007-full light chain sequence | Nucleic acid sequence of STIM007 light chain | GAAATTGTATTGACACAGTCTCCAGCCACCCTGTCTTTGTCTCCAGGGGAAAGA GCCACCCTCTCCTGCAGGGCCAGTCAGAGTGTTACCAACTACTTAGCCTGGCAC CAACAGAAACCTGGCCAGGCTCCCAGGCTCCTCATCTATGATGCATCAACAGG GCCACTGGCATCCCAGCCAGGTTCAGTGGCAGTGGGTCTGGGACAGACTTCACT |

SEQUENCE LISTING

| SEQ ID NO: | Name | Description | Sequence |
|---|---|---|---|
| | | | CTCACCATCAGCAGCCTAGAGCCTGAAGATTTGCAGTTTATTACTGTCAGCACC<br>GTAGCAACTGGCCTCTCACTTTCGGCGGAGGGACCAAGGTGGAGATCAAAcgta<br>cggtggctgcgctccctccgtgttcatcttcccgaccgagcagctgaagtccggcaccgttctgtcg<br>tgtgcctgctgaacaacttctacccccgaggccaaggtgcagtggaaggtggacaacgccctgcagt<br>ccggcaactcccaggaatccgtgaccgagcagcagagcaaggacagcacctacctccctgtcctccaccct<br>gacccgtgaccaaggtacgacgaagcgtacgcctgcgaagtgacccaccaggccctgt<br>ctagccccgtgaccaagtctttcaaccgggcgagtgt |
| 477 | STIM008-CDRH1 | Amino acid sequence of CDRH1 of STIM008 using IMGT | GFSLSTSGVG |
| 478 | STIM008-CDRH2 | Amino acid sequence of CDRH2 of STIM008 using IMGT | IYWDDDK |
| 479 | STIM008-CDRH3 | Amino acid sequence of CDRH3 of STIM008 using IMGT | THGYGSASYYHYGMDV |
| 480 | STIM008-Heavy chain variable region | Amino acid sequence of V<sub>H</sub> of STIM008 | QITLKESGPTLVKPTQTLTLTCTFSGFSLSTSGVGVGWIRQPPGKALEWLAVIYWD<br>DDKRYSPSLKSRLTITKDTSKNQVVLTMTNMDPVDTATYFCTHGYGSASYYHYGM<br>DVWGQGTTVTVSS |
| 481 | STIM008-Heavy chain variable region | Nucleic acid sequence of V<sub>H</sub> of STIM008 | CAGATCACCTTGAAGGAGTCTGGTCCTACGCTGGTGAAACCCACAGACCCTC<br>ACGCTGACCTGCACCTTCTCTGGGTTCTCACTCAGCACTAGTGGAGTGGGTGTG<br>GGCTGGATCCGTCAGCCCCCAGGAAAGGCCCTGGAGTGGCTTGCAGTCATTTAT<br>TGGGATGATGATAAGCGCTACAGCCCATCTCTGAAGAGCAGGCTCACCATCACC<br>AAGGACACCCTCCAAAAACCAGGTGGTCCTTACAATGACCAACATGACCCTGTG<br>GACACAGCCACCTATATTCTGTACACACGGATATGGTTCGGCGAGTTATTACCACT<br>ACGGTATGGACGTCTGGGGCCAAGGGACCACGGTCACCGTCTCCTCA |
| 482 | STIM008-full heavy chain sequence | Amino acid sequence of STIM008 heavy chain | QITLKESGPTLVKPTQTLTLTCTFSGFSLSTSGVGVGWIRQPPGKALEWLAVIYWD<br>DDKRYSPSLKSRLTITKDTSKNQVVLTMTNMDPVDTATYFCTHGYGSASYYHYGM<br>DVWGQGTTVTVSSASTKGPSVFPLAPSSKSTSGGTAALGCLVKDYFPEPVTVSWN<br>SGALTSGVHTFPAVLQSSGLYSLSSVVTVPSSSLGTQTYICNVNHKPSNTKVDKKVE<br>PKSCDKTHTCPPCPAPELLGGPSVFLFPPKPKDTLMISRTPEVTCVVVDVSHEDPEV<br>KFNWYVDGVEVHNAKTKPREEQYNSTYRVVSVLTVLHQDWLNGKEYKCKVSNKA<br>LPAPIEKTISKAKGQPREPQVYTLPPSRDELTKNQVSLTCLVKGFYPSDIAVEWESN<br>GQPENNYKTTPPVLDSDGSFFLYSKLTVDKSRWQQGNVFSCSVMHEALHNHYTQ<br>KSLSLSPGK |
| 483 | STIM008-full heavy chain sequence | Nucleic acid sequence of STIM008 heavy chain | CAGATCACCTTGAAGGAGTCTGGTCCTACGCTGGTGAAACCCACAGACCCTC<br>ACGCTGACCTGCACCTTCTCTGGGTTCTCACTCAGCACTAGTGGAGTGGGTGTG<br>GGCTGGATCCGTCAGCCCCCAGGAAAGGCCCTGGAGTGGCTTGCAGTCATTTAT<br>TGGGATGATGATAAGCGCTACAGCCCATCTCTGAAGAGCAGGCTCACCATCACC<br>AAGGACACCCTCCAAAAACCAGGTGGTCCTTACAATGACCAACATGACCCTGTG<br>GACACAGCCACCTATATTCTGTACACACGGATATGGTTCGGCGAGTTATTACCACT<br>ACGGTATGGACGTCTGGGGCCAAGGGACCACGGTCACCGTCTCCTCAGCAGCA<br>CCAAGGGCCCCTCTGTTCCCCTGGCCCCTCCAGCAAGTCCTCCACCTCTGGCG |

| SEQ ID NO: | Name | Description | Sequence |
|---|---|---|---|
| | | | GAACAGCGCCTCTGGGCTGCCTCTGAAGGACTACTTCCCGAGCTGTGACCG |
| | | | TGTCCTGGAACTCTGGCGCTGTACTCCCTGTCCTCCGTGCTGACCGTGCCC |
| | | | TGCAGTCCTCCGGACTCCTGTCCCTGTCCTCCGTGCTGACCGTGCCTTCAGCT |
| | | | CTCTGGGACACCAAGACCTACATCTGCAACGTGAACCACAAGCCCTCCAACACCAA |
| | | | GGTGGACAAGAAGGTGGAACCCAAGTCCTGCGACAAGACCCACACCTGTCCCC |
| | | | TTGTCTGCCCCGGACTGCTGGGCGGACCTTCCGTGTTCCTGTTCCCCCCAAA |
| | | | GCCCAAGGACACCCTGATGATCTCCCGGACCCCCGAAGTGACCTGCGTGGT |
| | | | GGATGTGTCCACGAGGACCCTGAGGTCAAGTTCAATTGGTACGTGGACGGCGT |
| | | | GGAAGTGCACAACGCCAAGACCAAGCCTAGAGAGGAACAGTACAACTCCACCTA |
| | | | CCGGGTGGTCCGTGCTGACCGTGCTGCACCAGGATTGGCTGAACGGCAAAG |
| | | | AGTACAAGTGCAAGGTCTCCAACAAGGCCCTGCCCGCCATCGAAAAGACCA |
| | | | TCTCCAAGGCCAAGGGCCAGCCCCGGGAACCCCAGGTGTACACCCTGCCCCCTA |
| | | | GCAGGACGAGCTGCTGCAAGAACCAGGTGTCCCTGACCTGTCTCGTGAAGGCT |
| | | | TCTACCCCTCCGATATCGCCGTGGAATGGGAGTCCAACGGCCAGCCTGAGAACA |
| | | | ACTACAAGACCACCCCCCTGTCTGACTCCGACGGCTCATTCTTCCTGTACAG |
| | | | CAAGCTGACAGTGGACAAGTCCAGGTGGCAGCAGGGCAACGTCTTCTCTGC |
| | | | CGTGATGCACGAGGCCCTGCACAACCACTACACCCAGAAGTCCCTGTCCCTGAG |
| | | | CCCCGGCAAGTGATGA |
| 484 | STIM008-CDRL1 | Amino acid sequence of CDRL1 of STIM008 using IMGT | QSVTNY |
| 485 | STIM008-CDRL2 | Amino acid sequence of CDRL2 of STIM008 using IMGT | DAS |
| 486 | STIM008-CDRL3 | Amino acid sequence of CDRL3 of STIM008 using IMGT | QQRSNWPLT |
| 487 | STIM008-Light chain variable region | Amino acid sequence of V$_L$ of STIM008 | EIVLTQSPATLSLSPGERATLSCRASQSVTNYLAWHQQKPGQAPRLLIYDASNRAT GIPARFSGSGSGTDFTLTISSLEPEDFAVYYCQQRSNWPLTFGGGTKVEIK |
| 488 | STIM008-Light chain variable region | Nucleic acid sequence of V$_L$ of STIM008 | GAAATTGTGTTGACACAGTCTCCAGCCACCCTGTCTTTGTCTCCAGGGGAAAGA GCCACCCTCTCCTGCAGGGCCAGTCAGAGTGTTACCAACTACTTAGCCTGGCAC CAACAGAAACCTGGCCAGGCTCCCAGGCTCCTCATCTATGATGCATCCAACAGG GCCACTGGCATCCCAGCCAGGTTCAGTGGCTCTGGGACAGACTTCACT CTCACCATCAGCAGCCTAGAGCCTGAAGATTTTGCAGTTTATTACTGTCAGCAGC GTAGCAACTGGCCTCTCACTTTCGGCGGAGGGACCAAGGTGGAGATCAAA |
| 489 | STIM008-full light chain sequence | Amino acid sequence of STIM008 light chain | EIVLTQSPATLSLSPGERATLSCRASQSVTNYLAWHQQKPGQAPRLLIYDASNRAT GIPARFSGSGSGTDFTLTISSLEPEDFAVYYCQQRSNWPLTFGGGTKVEIKRTVAAP SVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 490 | STIM008-full light chain sequence | Nucleic acid sequence of STIM008 light chain | GAAATTGTGTTGACACAGTCTCCAGCCACCCTGTCTTTGTCTCCAGGGGAAAGA GCCACCCTCTCCTGCAGGGCCAGTCAGAGTGTTACCAACTACTTAGCCTGGCAC CAACAGAAACCTGGCCAGGCTCCCAGGCTCCTCATCTATGATGCATCCAACAGG GCCACTGGCATCCCAGCCAGGTTCAGTGGCTCTGGGACAGACTTCACT |

-continued

SEQUENCE LISTING

| SEQ ID NO: | Name | Description | Sequence |
|---|---|---|---|
| | | | CTCACCATCAGCAGCCTAGAGCCTGAAGATTTTGCAGTTTATTACTGTCAGCAGC GTAGCAACTGGCCTCTCCACTTTCGGCGGAGGGACCAAGGTGGAGATCAAAcgtac ggtggcgcgtccctccgtgttcatctcaccccgcgaggccaaggtcgacgagcagctgaagtccggacagtccggcaccgcttctgtcgt gtgcctgctgaacaacttctaccccgcgaggccaaggtcgcaggtggaactgcagtccaatctggaacaacgcctgcagtc cggcaactcccaggaatccgtcgacgagcagacgcccaaggacagcacctactccctgtcctccacctg accctgtccaaggccgactacgagaagcacacaagtctacgcctgcgaagtgacccaccaggcctgtct agcccgtgaccaagtctttcaacggggcgagtgt |
| 491 | STIM009-CDRH1 | Amino acid sequence of CDRH1 of STIM009 using IMGT | GFTFSDYY |
| 492 | STIM009-CDRH2 | Amino acid sequence of CDRH2 of STIM009 using IMGT | ISSSSGSTI |
| 493 | STIM009-CDRH3 | Amino acid sequence of CDRH3 of STIM009 using IMGT | ARDFYDILTDSPYFYGVDV |
| 494 | STIM009-Heavy chain variable region | Amino acid sequence of V$_H$ of STIM009 | QVQLVESGGGLVKPGGSLRLSCAASGFTFSDYYMSWIRQAPGKGLEWVSYISSSGS TIYYADSVKGRFTISRDNAKNSLYLQINSLRAEDTAVYYCARDFYDILTDSPYFYYG VDVWGQGTTVTVSS |
| 495 | STIM009-Heavy chain variable region | Nucleic acid sequence of V$_H$ of STIM009 | CAGGTGCAGCTGGTGGAGTCTGGGGGAGGCTTGGTCAAGCCTGGAGGGTCCCT GAGACTCTCCTGTGCAGCCTCTGGATTCACCTTCAGTGACTACTACATGAGCTG GATCCGCCAGGCTCCAGGGAAGGGCTGGAGTGGGTTTCATACATTAGTAGTA GTGGTAGTACCATATACTACGCAGACTCTGTGAAGGGCCGATTCACCATCTCCA GGGACAACGCCAAGAACTCACTGTATCTGCAAATTAACAGCCTGAGAGCCGAGG ACACGGCCGTGTATTACTGTGCGAGAGATTTTACGATATTTGACTGATAGTC CGTACTTCTACTACGGTGTGGACGTCTGGGGCCAAGGGACCACGGTCACCGTCT CCTCA |
| 496 | STIM009-full heavy chain sequence | Amino acid sequence of STIM009 heavy chain | QVQLVESGGGLVKPGGSLRLSCAASGFTFSDYYMSWIRQAPGKGLEWVSYISSSGS TIYYADSVKGRFTISRDNAKNSLYLQINSLRAEDTAVYYCARDFYDILTDSPYFYYG VDVWGQGTTVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKK VEPKSCDKTHTCPPCPAPELLGGPSVFLFPPKPKDTLMISRTPEVTCVVVDVSHEDP EVKFNWYVDGVEVHNAKTKPREEQYNSTYRVVSVLTVLHQDWLNGKEYKCKVSN KALPAPIEKTISKAKGQPREPQVYTLPPSRDELTKNQVSLTCLVKGFYPSDIAVEWE SNGQPENNYKTTPPVLDSDGSFFLYSKLTVDKSRWQQGNVFSCSVMHEALHNHYT QKSLSLSPGK |
| 497 | STIM009-full heavy chain sequence | Nucleic acid sequence of STIM009 heavy chain | CAGGTGCAGCTGGTGGAGTCTGGGGGAGGCTTGGTCAAGCCTGGAGGGTCCCT GAGACTCTCCTGTGCAGCCTCTGGATTCACCTTCAGTGACTACTACATGAGCTG GATCCGCCAGGCTCCAGGGAAGGGGCTGGAGTGGGTTTCATACATTAGTAGTA GTGGTAGTACCATATACTACGCAGACTCTGTGAAGGGCCGATTCACCATCTCCA GGGACAACGCCAAGAACTCACTGTATCTGCAAATTAACAGCCTGAGAGCCGAGG ACACGGCCGTGTATTACTGTGCGAGAGATTTTACGATATTTGACTGATAGTC CGTACTTCTACTACGGTGTGGACGTCTGGGGCCAAGGGACCACGGTCACCGTCT |

| SEQ ID NO: | Name | Description | Sequence |
|---|---|---|---|
| | | | CCTCAGCCAGCACCAAGGGCCCCTCTGTTCCCCTGGCCCCTTCCAGCAAGT<br>CCACCTCTGGCGGCACAGCGGCCCTGGGCTGCCTGGTCAAGGACTACTTCCCG<br>AGCCTGTGACCGTGTCCTGGAACTCTGGCGCTCTGACCAGCGGAGTGCACACCT<br>TCCCTGTCTGTGCTGCAGTCCTCCGGACTCTACTCCCTGTCCTCCGTCGTGACCG<br>TGCCTTCCAGCTCTGGGCACCAGACCTACATCTGCAACGTGAACCACAAGCC<br>CTCCAACACCAAGGTGGACAAGAAGGTGGAACGCAAGTCTTGCGACAAGACCCA<br>CACCTGTCCCCCTTGTCCTGCCCCTGAACTGCTGGGCGGACCTTCCGTGTTCCT<br>GTTCCCCCCAAAGCCCAAGGACACCCTGATGATCTCCCGGACCCCCGAAGTGAC<br>CTGCGTGGTGGTGGATGTGTCCCACGAGGACCCTGAAGTGAAGTTCAATTGGTA<br>CGTGGACGGCGTGGAAGTGCACAACGCCAAGACCAAGCCTAGAGAGGAACAGT<br>ACAACTCCACCTACCGGGTGGTGTCCGTGCTGACCGTGCTGCACCAGGATTGGC<br>TGAACGGCAAAGAGTACAAGTGCAAGGTCTCCAACAAGGCCCTGCCTGCCCCA<br>TCGAAAAGACCATCTCCAAGGCCAAGGGCCAGCCCCGGGAACCCCAGGTGTACA<br>CACTGCCCCCTAGCAGGGACGAGCTGACCAAGAACCAGGTGTCCCTGACCTGTC<br>TCGTGAAAGGCTTCTACCCCTCCGATATCGCCGTGGAATGGGAGTCCAACGGCC<br>AGCCTGAGAACAACTACAAGACCACCCCCCTGTGCTGGACTCCGACGGCTCAT<br>TCTTCCTGTACAGCAAGCTGACAGTGGACAAGTCCCGGTGGCAGCAGGGCAACG<br>TGTTCTCCTGCTCCGTGATGCACGAGGCCCTGCACAACCACTACACCCAGAAGT<br>CCCTGTCCCTGAGCCCGGGCAAGTGATGA |
| 498 | STIM009-CDRL1 | Amino acid sequence of CDRL1 of STIM009 using IMGT | QSLLHSNGYNY |
| 499 | STIM009-CDRL2 | Amino acid sequence of CDRL2 of STIM009 using IMGT | LGS |
| 500 | STIM009-CDRL3 | Amino acid sequence of CDRL3 of STIM009 using IMGT | MQALQTPRT |
| 501 | STIM009-Light chain variable region | Amino acid sequence of V$_L$ of STIM009 | DIVMTQSPLSLPVTPGEPASISCRSSQSLLHSNGYNYLDWYLQKPGQSPQLLIYLGS<br>NRASGVPDRFSGSGSGTDFTLKISRVEAEDVGVYYCMQALQTPRTFGQGTKVEIK |
| 502 | STIM009-Light chain variable region | Nucleic acid sequence of V$_L$ of STIM009 | GATATTGTGATGACTCAGTCTCCACTCTCCCTGCCCGTCACCCCTGGAGAGCCG<br>GCCTCCATCTCCTGCAGGTCTAGTCAGAGCCTCCTGCATAGTAATGGATACAACT<br>ATTTGGATTGGTACCTGCAGAAGCCAGGCCAGTCTCCACAGCTCCTGATCTATT<br>TGGGTTCTAATCGGGCCTCCGGGGTCCCTGACAGGTTCAGTGGCAGTGGATCA<br>GGCACAGATTTTACACTGAAAATCAGCAGAGTGGAGGCTGAGGATGTTGGGGTT<br>TATTACTGCATGCAAGCTCTACAAACTCCTCGGACGTTCGGCCAAGGGACCAAG<br>GTGGAAATCAAA |
| 503 | STIM009-full light chain sequence | Amino acid sequence of STIM009 light chain | DIVMTQSPLSLPVTPGEPASISCRSSQSLLHSNGYNYLDWYLQKPGQSPQLLIYLGS<br>NRASGVPDRFSGSGSGTDFTLKISRVEAEDVGVYYCMQALQTPRTFGQGTKVEIKR<br>TVAAPSVFIFPPSDEQLKSGTASVVCLLNNFYPREAKVQWKVDNALQSGNSQESVT<br>EQDSKDSTYSLSSTLTLSKADYEKHKVYACEVTHQGLSSPVTKSFNRGEC |

SEQUENCE LISTING -continued

| SEQ ID NO: | Name | Description | Sequence |
|---|---|---|---|
| 504 | STIM009-full light chain sequence | Nucleic acid sequence of STIM009 light chain | GATATTGTGATGACTCAGTCTCCACTCTCCCTGCCCGTCACCCTGGAGCCG GCCTCCATCTCCTGCAGGTCTAGTCAGAGCCTCCTGCATAGTAATGATACAACT ATTTGATTGTACTTGCAGAAGCCAGGACAGTCTCCACAGCTCCTGATCTATT TGGGTTCTAATCGGGCCTCCGGGGTCCCTGACAGGTTCAGTGGCAGTGGATCA GGCACAGATTTTACACTGAAAATCAGCAGAGTCGAGGATGTTGGGGTT TATTACTGCATGCAAGCTCTACAACTCTCTGGACGTTCGCCAAGGACCAAG GTGGAAATCAAAcgtacggtggccgctcccatctttcccactttccgacgagcagttgaa gtccggcaccgcttctgtgtgcttcatcttcccgccggccgatgaacaactctaccccgaggccaagtgcagtggaag gtggataacgccctgcagtccggtaacgtccaggagagtgtcacaggaggaggactccaagacagcac ctactccctccagcagcacgagaaggccacccaagtgtacggcccgtgcgaa gtgaccaccaggcctgtcacgccccgtgaccaagtctttcaaccgggcgagtgt |
| 505 | Human PD-L1 Flag His (KYPROT286) | Amino acid sequence of KYPROT286 with FLAG tag in bold and underlined and histidine tag in bold | FTVTVPKDLYVVEYGSNMTIECKFPVEKQLDLAALIVYWEMEDKNIIQFVHGEEDLK VQHSSYRQRARLLKDQLSLGNAALQITDVKLQDAGVYRCMISYGGADYKRINKV NAPYNKINQRILVVDPVISEHELTCQAEGYPKAEVIWTSSDHQVLSGKTITTNSKR EEKLFNVTSTLRINTTTNEIFYCTFRRLDPEENHTAELVIPELPLAHPPNERTIEGRDYKDDDDKHHHHHH |
| 506 | Mature human ICOS | Mature amino acid sequence of human ICOS | EINGSANYEMFIFHNGGVQILCKYPDIVQQFKMQLLKGGQILCDLTKTKGSNIVSI KSLKFCHSQLSNNSVSFFLYNLDHSHANYYFCNLSIFDPPPFKVTLTGGYLHIYESQL CCQLKFWLPIGCAAFVVCIIGCILICWLITKKKYSSSVHDPNGEYMFMRAVNTAKK SRLTDVTL |
| 507 | Human ICOS extracellular domain | Amino acid sequence of human ICOS extracellular domain | EINGSANYEMFIFHNGGVQILCKYPDIVQQFKMQLLKGGQILCDLTKTKGSNIVSI KSLKFCHSQLSNNSVSFFLYNLDHSHANYYFCNLSIFDPPPFKVTLTGGYLHIYESQL CCQLKF |
| 508 | Human ICOS with signal peptide | Amino acid sequence of human ICOS (signal peptide is underlined) | MKSGLWYFFLFCLRIKVLTGEINGSANYEMFIFHNGGVQILCKYPDIVQQFKMQLLK GGQILCDLTKTKGSGNTVSIKSLKFCHSQLSNNSVSFFLYNLDHSHANYFCNLSIF DPPPFKVTLTGGYLHIYESQLCCQLKFWLPIGCAARNVCIIGCILICWLIKKKYSSS VHDPNGEYMFMRAVNTAKKSRLTDVTL |
| 509 | Isoform of human ICOS (Q9Y6W8-2) | Amino acid sequence of a human ICOS isoform | The sequence of this isoform differs from the canonical sequence in its cytoplasmic domain as follows: 168-199: KYSSSVHDPNGEYMFMRAVNTAKKSRLTDVTLM |
| 510 | Mature mouse ICOS | Amino acid sequence of mature mouse ICOS | EINGSADHRMFSFHNGGVQISCKYPETVQQLKMRLFREREVLCELTKTKGSGNAVS IKNPMLCLYHLSNNSVSFFLNNPDSSQGSYYFCSLSIFDPPPFQERNLSGGYLHIYES QLCCQLKTVVQVTE |
| 511 | Mouse ICOS extracellular domain | Amino acid sequence of the extracellular domain of mouse ICOS | EINGSADHRMFSFHNGGVQISCKYPETVQQLKMRLFREREVLCELTKTKGSGNAVS IKNPMLCLYHLSNNSVSFFLNNPDSSQGSYYFCSLSIFDPPPFQERNLSGGYLHIYES QLCCQLK |
| 512 | Mouse ICOS with signal peptide | Amino acid sequence of mouse ICOS (signal peptide is underlined) | MGWSCIILFLVATATGVHSEINGSADHRMFSFHNGGVQISCKYPETVQQLKMRLFR EREVLCELTKTKGSGNAVSIKNPMLCLYHLSNNSVSFFLNNPDSSQGSYYFCSLSIF DPPPFQERNLSGGYLHIYESQLCCQLKTVVQVTE |

-continued

SEQUENCE LISTING

| SEQ ID NO: | Name | Description | Sequence |
|---|---|---|---|
| 513 | Cynomolgus ICOS with signal peptide | Amino acid sequence of cynomolgus ICOS (signal peptide is underlined) | MKSGLVVYFFL FCLHMKVLTG EINGSANYEM FIFHNGVQI LCKYPDIVQQ FKMQLLKGGQILCDLTKTKGSGNKVSIKSLKFCHSQLSNNSVSFFLYNLD RSHANYYFCNLSIFDPPFKVTLIGGYLHIYESQLCCQLKFWLPIGCATF VVVCIFPGCILICWLIKKKYSSTVHDPNGEYMFMRAVNTAKKSRLTGTTP |
| 514 | Cynomolgus ICOS extracellular domain | Amino acid sequence of cynomolgus ICOS extracellular domain | EINGSANYEMFIFHNGGVQILCKYPDIVQQFKMQLLKGGQILCDLTKTKG SGNINSIKSLKFCHSQLSNNSVSFFLYNLDRSHANYYFCNLSIFDPPFK VTLTGGYLHIYESQLCCQLK |
| 515 | Human ICOS ligand | Amino acid sequence of human ICOS ligand comprising extracellular domain | DTQEKEVRAMVGSDVELSCACPEGSRFDLNDVYVWQTSESKTVVTYHIPQNSSL ENVDSRYRNRALMSPAGMLRGDFSLRLFNVTPQDEQKFHCLVLSQSLGFQEVLSVE VTLHVAANFSVPVVSAPHSPSQDELTFTCTSINGYPRPNVYWINKTDNSLLDQALQ NDTVFLNMRGLYDVVSVLRIARTPSVNIGCCIENVLLQQNLTVGSQTGNDIGERDK ITENPVSTGEKNAATWS |
| 516 | Human ICOS ligand | | MRLGSPGLLFLLFSSLRADTQEKEVRAMVGSDVELSCACPEGSRFDLNDVYVWQT SESKTVVTYHIPQNSSLENVDSRYRNRALMSPAGMLRGDFSLRLFNVTPQDEQKFH CLVLSQSLGFQEVLSVEVTLHVAANFSVPVVSAPHSPSQDELTFTCTSINGYPRPNV YWINKTDNSLLDQALQNDTVFLNMRGLYDVVSVLRIARTPSVNIGCCIENVLLQQN LTVGSQTGNDIGERDKITENPVSTGEKNAATWSILAVLCLLVVVAVAIGWVCRDRC LQHSYAGAWAVSPETELTGHV |
| 517 | C-terminal amino acid sequence of hIL-2 | Amino acids 21 to 133 of hIL-2 with R38W mutation (bold & underlined) | LQMILNGINNYKNPKLTAMLTFKFYMPKKATELKHLQCLEEELKPLEEVLNLAQSKN FHLRPRDLISNINIVLELKGSETTFMCEYADETATIVEFLNRWITFCQSIISTLT |
| 518 | C-terminal amino acid sequence of hIL-2 | Amino acids 21 to 133 of hIL-2 with R38Q mutation (bold & underlined) | LQMILNGINNYKNPKLTQMLTFKFYMPKKATELKHLQCLEEELKPLEEVLNLAQSKN FHLRPRDLISNINIVLELKGSETTFMCEYADETATIVEFLNRWITFCQSIISTLT |
| 519 | STIM002-Corrected Light chain variable region | Nucleic acid sequence of corrected VL of STIM002 | GATATTGTGATGACTCAGTCTCCACTCTCCCGTCCCGTCACCCCTGGAGAGCCG GCCTCCATCTCCTGCAGGTCTAGTCAGAGCCTCCTGCATAGTGATGATACAAC TATTTGGATTGGTACCTGCAGAAGCCAGGGCAGTCTCCACAGCTCCTGATCTAT TTGGGTTCTACTCGGGCCTCCGGGTTCCCTGACAGGTTCAGTGAGCAGTGGATCA GGCACAGATTTTACACTGAAAATCAGCAGAGTGGAGGCTGAGGATGTTGGGGTT TATTACTGCATGCAAGCTCTACAACTCCGCTCAGTTTTGGCCAGGGGACCAAG CTGGAGATCAAA |
| 520 | STIM002-Corrected full light chain sequence | Nucleic acid sequence of corrected STIM002 light chain | GATATTGTGATGACTCAGTCTCCACTCTCCCGTCCCGTCACCCCTGGAGAGCCG GCCTCCATCTCCTGCAGGTCTAGTCAGAGCCTCCTGCATAGTGATGATACAAC TATTTGGATTGGTACCTGCAGAAGCCAGGGCAGTCTCCACAGCTCCTGATCTAT TTGGGTTCTACTCGGGCCTCCGGGTTCCCTGACAGGTTCAGTGAGCAGTGGATCA GGCACAGATTTTACACTGAAAATCAGCAGAGTGGAGGCTGAGGATGTTGGGGTT TATTACTGCATGCAAGCTCTACAACTCCGCTCAGTTTTGGCCAGGGGACCAAG |

-continued

SEQUENCE LISTING

| SEQ ID NO: | Name | Description | Sequence |
|---|---|---|---|
| 521 | STIM003-Corrected heavy chain variable region | Nucleic acid sequence of corrected VH of STIM003 | CTGGAGATCAAAcgtacggtggcgcctcctccgcgttcatcttcccaccttccgacgagcagtgaa<br>gtccggcaacgccttctgtgctgctgtgtcctgctgctgaacaacttctcacccccgagggcaaggtgcagtggaag<br>gtggacaacgccctgcagtccggcaactccaggaatccgtgaccgagcaggacaaggaccaaggacagcac<br>ctactccctgcctccaccctgaccctgcaaggccgactacggaggacacaaggtgtacgcctgcgaa<br>gtgacccaccaaggcctgtctagccccgtgacaagtctttcaaccgggcgagtgt<br>GAGGTCAGCTGGTGGAGTCTGGGGGAGGTGTGGTACGGCCTGGGGGTCCCT<br>GAGACTTCCTGTGTAGCCTCTGGAGTCACCTTTGATGATTATGGCATGAGCTG<br>GGTCCCGCCAAGCTCCAGGGAAGGGCTGGAGTGGGTCTCTGTATTAATTGA<br>ATGGTGGCGACACAGATTATTCAGACTCTGTGAAGGGCCGATTCACCATCTCA<br>GAGACAACGCCAAGAACTCCCTGTATCTACAAATGAATAGTCTGAGAGCCGAGG<br>ACACGGCCCTTGTATTACTGTGCGAGGGATTTCTATGGTTCGGGGAGTTATTATC<br>ACGTTCCTTTTGACTACTGGGGCCAGGGAATCCTGGTCACCGTCTCCTCA |
| 522 | STIM003-Corrected full heavy chain sequence | Nucleic acid sequence of corrected STIM003 heavy chain | GAGGTCAGCTGGTGGAGTCTGGGGGAGGTGTGGTACGGCCTGGGGGTCCCT<br>GAGACTTCCTGTGTAGCCTCTGGAGTCACCTTTGATGATTATGGCATGAGCTG<br>GGTCCCGCCAAGCTCCAGGGAAGGGCTGGAGTGGGTCTCTGTATTAATTGA<br>ATGGTGGCGACACAGATTATTCAGACTCTGTGAAGGGCCGATTCACCATCTCA<br>GAGACAACGCCAAGAACTCCCTGTATCTACAAATGAATAGTCTGAGAGCCGAGG<br>ACACGGCCCTTGTATTACTGTGCGAGGGATTTCTATGGTTCGGGGAGTTATTATC<br>ACGTTCCTTTTGACTACTGGGGCCAGGGAATCCTGGTCACCGTCTCCTCAGCCA<br>GCACCAAGGGCCCCTCTGGTGTTCCCTCTGGCCCCTTCCAGCAAGTCCACCTCTG<br>GCGGAACAGCCGCCTCTGGGCTGCTGTAACTTCGGCGGTAAGGACTACTTCCCCGAGCCTGTGA<br>CCGTGTCCAGTGCCTGGAACTCGGCGCTGTACTCCCTGTCCTCCGTGACCGTGCCTTCCA<br>GCTCTCTGGGCACCCAGACCTACATCTGCAACGTGAACCACAAGCCCTCCAACAC<br>CAAGGTGGACAAGAAGTGGAACTGCGAAGTCCCCTCCTGCCCCGAAGACCGTGTGTCC<br>CCCTTGTCCCCTGCCCCAAGTCTGGAGCCCGAGCACTTCCGTGTTCCTGTTCCCCCC<br>AAGCCCAAGGACACCCTGATGATCTCCAGGACCCCTGAAGTGAAGTTCAATTGGTACGTGGAC<br>GGTGGAGTGTGCCACGAGGACCCTGAAGTGCACCAGCAGTACAACTCCA<br>CCGCGGAAGTGCACAACGCCAAGACCAAGCCTAGAGAGGAACAGTACAACTCCA<br>CCTACCGGGTGGTGTCCGTGCTGACCGTCCTGCACCAGGATTGGCTGAACGGCA<br>AAGAGTACAAGTGCAAGGTGTCCAACAAGGCCCTGCCTGCCCCATCGAAAGA<br>CCAATCTCCAAGGCCAAGGGCCAGCCCCGAGAACCCCAGGTGTACACACTGCCC<br>CTAGCAGGACGAGCTGACCAAGAACCAGGTGTCCCTGACCTGTCTGGGTGAAAG<br>GCTTCTACCCCTCCGATATCGCCGTGAATGGGAGTCCAGCGGCTCATTCTTCCTGTA<br>ACAACTACAAGACCACCCCTGTCTGCTGACTCCGACGGCTCCAGCAGGACCCCTGAGA<br>CAGCAAGGTGCAGTGGACAGGTGGCAGCAGGGGAACGTCCAGCTACACCCAGAAGTCCCTGTCCT<br>CTCCGGTGATGCACGAGGCCCTGCACAACCACTACACCCAGAAGTCCCTGTCCCT<br>GAGCCCCGGCAAGTGATGA |
| 523 | Human IgG1 constant region | IGHG1*03 | Human Heavy Chain Constant Region (IGHG1*03) Nucleotide Sequence | gcttccaccaaggccccatcggtcttccccctggcaccctctccaagagcacctctgggggcacagcgg<br>ccctgggctgcctggtcaaggactacttcccgaaccggtgacggtgtcgtggaactcaggcgccctgac<br>cagcggcgtgcacaccttcccggctgtcctacagtctcagtctactccctcagcagcgtggtgaccg<br>tgccctccagcagcttgggcacccagacctacatctgcaacgtgaatcacaagcccagcaacaccaagg<br>tggacaagagagttgagcccaaatcttgtgacaaaactcacacatgcccaccgtgcccagcacctgaact<br>cctggggggaccgtcagtcttcctcttccccccaaaacccaaggacaccctcatgatctccggacccctg |

| SEQ ID NO: | Name | Description | Sequence |
|---|---|---|---|
| | | | aggtcacatcgtggtggtgacgtgagccacgaagacctgaggtcaagtcaactgtacgtggacg |
| | | | gcgtggaggtgcatatacccgtcctgaccagcaccgagaaacaacctgaatggctgctaacaa |
| | | | cagcgtcctccagccgtctgaccaccagacccaagaagaccatctccaaagccaaagggcagcccgagaaccacaggtgt |
| | | | acaccctgcccccatcccgggaggagatgaccaagaaccaggtcagctgacctgcctggtcaaaggct |
| | | | tctatcccagcgacatcgccgtggagtgggagagcaatgggcagccggagaacaactacaagaccac |
| | | | gcctcccgtgctggactccgacggctccttcttcctctatagcaagctcaccgtggacaagagcaggtggc |
| | | | agcaggggaacgtcttctcatgctccgtgatgcatgaggctctgcacaaccactacacgcagaagagcct |
| | | | ctcccctgtccccgggtaaa |
| 524 | | Human Heavy Chain Constant Region (IGHG1*03) Protein Sequence | A S T K G P S V F P L A P S S K S T S G G T A A L G C L V K D Y F P E P V T |
| | | | V S W N S G A L T S G V H T F P A V L Q S S G L Y S L S S V V T V P S S S |
| | | | L G T Q T Y I C N V N H K P S N T K V D K R V E P K S C D K T H T C P P C |
| | | | P A P E L L G G P S V F L F P P K P K D T L M I S R T P E V T C V V V D V S |
| | | | H E D P E V K F N W Y V D G V E V H N A K T K P R E E Q Y N S T Y R V V |
| | | | S V L T V L H Q D W L N G K E Y K C K V S N K A L P A P I E K T I S K A K |
| | | | G Q P R E P Q V Y T L P P S R E E M T K N Q V S L T C L V K G F Y P S D I |
| | | | A V E W E S N G Q P E N N Y K T T P P V L D S D G S F F L Y S K L T V D K |
| | | | S R W Q Q G N V F S C S V M H E A L H N H Y T Q K S L S L S P G K |
| 525 | IGHG1*04 | Human Heavy Chain Constant Region (IGHG1*04) Nucleotide Sequence | gctccaccaaggcccatcggtcttcccctggcaccctcctccaagagcacctctggggcacagcgg |
| | | | ccctgggctgcctggtcaaggactacttcccgaaccgtgacggtgtcgtggaactcaggcgccctgac |
| | | | cagcggcgtgcacaccttcccggctgtcctacagtcctcaggactctactccctcagcagcgtggtgaccg |
| | | | tgccctccagcagcttgggcacccagacctacatctgcaacgtgaatcacaagcccagcaacaccaagg |
| | | | tggacaagaaagttgagcccaaatcttgtgacaaaactcacacatgcccaccgtgcccagcacctgaact |
| | | | cctggggggaccgtcagtcttcctcttccccccaaaacccaaggacaccctcatgatctcccggacccctg |
| | | | aggtcacatgcgtggtggtggacgtgagccacgaagaccctgaggtcaagttcaactggtacgtggacg |
| | | | gcgtggaggtgcataatgccaagacaaagccgcgggaggagcagtacaacagcacgtaccgtgtggt |
| | | | cagcgtcctcaccgtcctgcaccaggactggctgaatggcaaggagtacaagtgcaaggtctccaacaa |
| | | | agccctcccagcccccatcgagaaaaccatctccaaagccaaagggcagccccgagaaccacaggtgt |
| | | | acaccctgcccccatcccgggatgagctgaccaagaaccaggtcagcctgacctgcctggtcaaaggctt |
| | | | ctatccagcgacatcgccgtggagtgggagagcaatgggcagccggagaacaactacaagaccacg |
| | | | cctcccgtgctggactccgacggctccttcttcctctacagcaagctcaccgtggacaagagcaggtggca |
| | | | gcaggggaacgtcttctcatgctccgtgatgcatgaggctctgcacaaccactacacgcagaagagcctc |
| | | | tccctgtctccgggtaaa |
| 526 | | Human Heavy Chain Constant Region (IGHG1*04) Protein sequence | ASTKGPSVFPLAPSSKSTSGGTAALGCLVKDYFPEPVTVSWNSGALTSGVHTFPAVL |
| | | | QSSGLYSLSSVVTVPSSSLGTQTYICNVNHKPSNTKVDKRVEPKSCDKTHTCPPCP |
| | | | APELLGGPSVFLFPPKPKDTLMISRTPEVTCVVVDVSHEDPEVKFNWYVDGVEVHN |
| | | | AKTKPREEQYNSTYRVVSVLTVLHQDWLNGKEYKCKVSNKALPAPIEKTISKAKGQ |
| | | | PREPQVYTLPPSRDELTKNQVSLTCLVKGFYPSDIAVEWESNGQPENNYKTTPPVL |
| | | | DSDGSFFLYSKLTVDKSRWQQGNIFSCSVMHEALHNHYTQKSLSLSPGK |
| 527 | IGHG2*01 & IGHG2*03 & IGHG2*05 | Human Heavy Chain Constant Region (IGHG2*01) Nucleotide Sequence | gctccaccaaggcccatcggtcttccccctggcgccctgctccaggagcacctccgagagcacagccg |
| | | | ccctgggctgcctggtcaaggactacttccccgaaccggtgacggtgtcgtggaactcaggcgctctgac |
| | | | cagcggcgtgcacaccttcccagctgtcctacagtcctcaggactctactccctcagcagcgtggtgaccg |
| | | | tgccctccagcaacttcggcacccagacctacacctgcaacgtagatcacaagcccagcaacaccaagg |
| | | | tggacaagacagttgagcgcaaatgttgtgtcgagtgcccaccgtgcccagcaccacctgtggcaggac |
| | | | | Human IgG2 constant region |

-continued

SEQUENCE LISTING

| SEQ ID NO: | Name | Description | Sequence |
|---|---|---|---|
| | | | cgtcagtctctcttcctcccccaaaccaaggacaccctcatgatctcccggaccccctgaggtcacgtgcg |
| | | | tggtggtggacgtgagccaccacgaagaccccgaggtccagttcaactggtacgtggacggcgtggaggtg |
| | | | cataatgccaagacaaagccacggaggagcagttcaacagcacgttccgtgtggtcagcgtcctcaccg |
| | | | ttgtgcaccaggactggctgaacggcaaggagtacaagtgcaaggtctccaacaaaggcctcccagc |
| | | | ccccatcgagaaaaccatctccaaaaccaaagggcagccccgagaaccacaggtgtacaccctgcccc |
| | | | catcccgggaggagatgaccaagaaccaggtcagcctgacctgcctggtcaaaggcttctaccccagcg |
| | | | acatcgccgtggagtgggagagcaatgggcagccggagaacaactacaagaccacacctcccatgctg |
| | | | gactccgacggctccttcttcctctacagcaagctcaccgtggacaagagcaggtggcagcaggggaac |
| | | | gtcttctcatgctccgtgatgcatgaggctctgcacaaccactacacgcagaagagcctctccctgtccg |
| | | | ggtaaa |
| 528 | | Human Heavy Chain Constant Region (IGHG2*01) Protein Sequence | ASTKGPSVFPLAPCSRSTSESTAALGCLVKDYFPEPVTVSWNSGALTSGVHTFPAVL QSSGLYSLSSVVTVPSSNFGTQTYTCNVDHKPSNTKVDKTVERKCCVECPPCPAPP VAGPSVFLFPPKPKDTLMISRTPEVTCVVVDVSHEDPEVQFNWYVDGVEVHNAKTK PREEQFNSTFRVVSVLTVVHQDWLNGKEYKCKVSNKGLPAPIEKTISKTKGQPREP QVYTLPPSREEMTKNQVSLTCLVKGFYPSDIAVEWESNGQPENNYKTTPPMLDSD GSFFLYSKLTVDKSRWQQGNVFSCSVMHEALHNHYTQKSLSLSPGK |
| 529 | Human IgG2 constant region IGHG2*02 | Human Heavy Chain Constant Region (IGHG2*02) Nucleotide Sequence | GCCTCCACCAAGGGCCCATCGGTCTTCCCCCTGGCGCCCTGCTCCAGGAGCACC TCCGAGAGCACAGCGGCCCTGGGCTGCCTGGTCAAGGACTACTTCCCCGAACCG GTGACGGTGTCGTGGAACTCAGGCGCTCTGACCAGCGGCGTGCACACCTTCCCG GCTGTCCTACAGTCCTCAGGACTCTACTCCCTCAGCAGCGTGGTGACCGTGACC TCCAGCAACTTCGGCACCCAGACCTACACCTGCAACGTAGATCACAAGCCCAGCA ACACCAAGGTGGACAAGACAGTTGAGCGCAAATGTTGTGTCGAGTGCCCACCGT GCCCAGCACCTGAGTTCCTGGGGGGACCGTCAGTCTTCCTCTTCCCCCCAAAACCCAA GAGCACCCTCATGATCTCCCGGACCCCTGAGGTCACGTGCGTGGTGGTGGACGT GAGCCACGAAGACCCCGAGGTCCAGTTCAACTGGTACGTGGACGGCATGGAGG TGCATAATGCCAAGACAAAGCCACGGGAGGAGCAGTTCAACAGCACGTTCCGTG TGGTCAGCGTCCTCACCGTCGTGCACCAGGACTGGCTGAACGGCAAGGAGTACA AGTGCAAGGTCTCCAACAAAGGCCTCCCAGCCCCCATCGAGAAAACCATCTCCAA AACCAAAGGGCAGCCCCGAGAACCACAGGTGTACACCCTGCCCCCATCCCGGGA GGAGATGACCAAGAACCAGGTCAGCCTGACCTGCCTGGTCAAAGGCTTCTACCC CAGCGACATCGCCGTGGAGTGGGAGAGCAATGGGCAGCCGGAGAACAACTACA AGACCACACCTCCCATGCTGGACTCCGACGGCTCCTTCTTCCTCTACAGCAAGCT CACCGTGGACAAGAGCAGGTGGCAGCAGGGGAACGTCTTCTCATGCTCCGTGAT GCATGAGGCTCTGCACAACCACTACACACAGAAGAGCCTCTCCCTGTCTCCGGG TAAA |
| 530 | | Human Heavy Chain Constant Region (IGHG2*04) Protein Sequence | ASTKGPSVFPLAPCSRSTSESTAALGCLVKDYFPEPVTVSWNSGALTSGVHTFPAVL QSSGLYSLSSVVTVTSSNFGTQTYTCNVDHKPSNTKVDKTVERKCCVECPPCPAPP VAGPSVFLFPPKPKDTLMISRTPEVTCVVVDVSHEDPEVQFNWYVDGMEVHNAKT KPREEQFNSTFRVVSVLTCLVKGEYKCKVSNKGLPAPIEKTISKTKGQPRE PQVYTLPPSREEMTKNQVSLTCLVKGFYPSDIAVEWESNQQPENNYKTTPPMLDS DGSFFLYSKLTVDKSRWQQGNVFSCSVMHEALHNHYTQKSLSLSPGK |
| 531 | Human IgG2 constant region IGHG2*04 | Human Heavy Chain Constant Region (IGHG2*04) Nucleotide Sequence | gcctccaccaagggcccatcggtcttccccctggcgccctgctccaggagcacagcg gcctgggctgcctggtcaaggactacttcccgaaccggtgacggtgtcgtggaactcaggcgccctga cagcggcgtgcacaccttcccagctgtcctacagtcctcaggactctactccctcagcagcgtggtgacc gtgccctccagcagcttgggcaccagaccatcaactgcaacgtagatcacaagcccagcaacaccaag |

| SEQ ID NO: | Name | Description | Sequence |
|---|---|---|---|
| | | | gtggacaagacagttgagctgctcctcccccaaaatgttgtcgagtgcccactgcccagtgcccactgtggcagga |
| | | | ccgtcagtctgactgctgagccacagagacaccccgaggtccagttcaactggtacgtggacggcgtggaggtgc |
| | | | gtggtgtgacgtgagccacgaagaccacggaggagcagttcaacagcacgttcctgtgtcagtgacgtcctcac |
| | | | gcataatgccaagacaaagccaccaggagcagttcaacagcagctacaaagtacaaggtgcaggtgctcctcac |
| | | | cgttgtgcaccaggactgctgaacggcaaggagtacaagtgcaaggtctccaacaaaggcctcccaaggcctcccag |
| | | | ccccatcgagaaaaccatctccaaagccaaagggcagccccgagaaccacaggtgtacaccctgccc |
| | | | ccatcccgggaggagatgaccaagaaccaggtcagcctgacctgcctggtcaaaggcttctaccccagc |
| | | | gacatcgccgtggagtgggagagcaatgggcagccggagaacaactacaagaccacacctcccatgct |
| | | | ggactcctacagcgtcctctccttcctctacagcaagctcacggtgacaagagcaggtggcagggaa |
| | | | cgtcttcctcatgctccgtgatgcatgaggctctgcacaaccactacacgcagaagagcctctccctgtctcc |
| | | | gggtaaa |
| 532 | | Human Heavy Chain Constant Region (IGHG2*04) Protein Sequence | ASTKGPSVFPLAPCSRSTSESTAALGCLVKDYFPEPVTVSWNSGALTSGVHTFPAVL |
| | | | QSSGLYSLSSVVTVPSSLGTQTYTCNVDHKPSNTKVDKTVERKCCVECPPCPAPP |
| | | | VAGPSVFLFPPKPKDTLMISRTPEVTCVVVDVSHEDPEVQFNWYVDGVEVHNAKTK |
| | | | PREEQFNSTFRVVSLTVVHQDWLNGKEYKCKVSNKGLPAPIEKTISKTKGQPREP |
| | | | QVYTLPPSREEMTKNQVSLTCLVKGFYPSDIAVEWESNGQPENNYKTTPPMLDSD |
| | | | GSFFLYSKLTVDKSRWQQGNVFSCSVMHEALHNHYTQKSLSLSPGK |
| 533 | IGHG2*06 | Human Heavy Chain Constant Region (IGHG2*06) Nucleotide Sequence | GCCTCCACCAAGGGCCCATCCGTCTTCCCCCTGGCGCCCTGCTCCAGGAGCACC |
| | | | TCCGAGAGCACAGCGGCCCTGGGCTGCCTGGTCAAGGACTACTTCCCCGAACCG |
| | | | GTGACGGTGTCGTGGAACTCAGGCGCTCTGACCAGCGGCGTGCACACCTTCCCG |
| | | | GCTGTCCTACAGTCTCCTCAGGACTCTACTCCCTCAGCAGCGTGGTGACCGTGCCC |
| | | | TCCAGCAACTTCGGCACCAGACCTACACCTGCAACGTAGATCAAGCCCAGCA |
| | | | ACACCAAGGTGGACAAGACAGTTGAGCGCAAATGTTGTGTCGAGTGCCCACCGT |
| | | | GCCCAGCACCACCTGTGCCAGGACCCTCAGTCTTCCTCTTCCCCCCAAAACCCAA |
| | | | GGACACCCTCATGATCTCCCGGACCCCTGAGGTCACGTGCGTGGTGGTGGACGT |
| | | | GAGCCACGAAGACCCCGAGGTCCAGTTCAACTGGTACGTGGACGGCGTGGAGG |
| | | | TGCATAATGCCAAGACAAAGCCACGGGAGGAGCAGTTCAACAGCACGTTCCGTG |
| | | | TGGTCAGCGTCCTCACCGTCCTGCACCAGGACTGGCTGAACGGCAAGGAGTACA |
| | | | AGTGCAAGGTCTCCAACAAAGGCCTCCCAGCCCCCATCGAGAAAACCATCTCCAA |
| | | | AACCAAAGGGCAGCCCCGAGAACCACAGGTGTACACCCTGCCCCCATCCCGGGA |
| | | | GGAGATGACCAAGAACCAGGTCAGCCTGACCTGCCTGGTCAAAGGCTTCTACCC |
| | | | CAGCGACATCTTCCGTGGAGTGGGAGAGCAATGGGCAGCCGGAGAACAACTACAA |
| | | | GACCACACCTCCCATGCTGGACTCCGACGGCTCCTTCTTCCTCTACAGCAAGCTC |
| | | | ACCGTGGACAAGAGCAGGTGGCAGCAGGGGAACGTCTTCTCATGCTCCGTGATG |
| | | | CATGAGGCTCTGCACAACCACTACACACAGAAGAGCCTCTCCCTGTCTCCGGGT |
| | | | AAA |
| 534 | | Human Heavy Chain Constant Region (IGHG2*06) Protein Sequence | ASTKGPSVFPLAPCSRSTSESTAALGCLVKDYFPEPVTVSWNSGALTSGVHTFPAVL |
| | | | QSSGLYSLSSVVTVPSSNFGTQTYTCNVDHKPSNTKVDKTVERKCCVECPPCPAPP |
| | | | VAGPSVFLFPPKPKDILMISRTPEVTCVVVDVSHEDPEVQFNWYVDGVEVHNAKTK |
| | | | PREEQFNSTFRVVSLTVVHQDWLNGKEYKCKVSNKGLPAPIEKTISKTKGQPREP |
| | | | QVYTLPPSREEMTKNQVSLICLVKGFYPSDISVEWESNGQPENNYKTTPPMLDSD |
| | | | GSFFLYSKLIVDKSRWQQGNVFSCSVMHEALHNHYTQKSLSLSPGK |

| SEQ ID NO: | Name | Description | Sequence |
|---|---|---|---|
| 535 | Human Cλ constant region | IGLC7*03 Cλ Light Chain Constant Region (IGLC7*03) Nucleotide Sequence | GGTCAGCCCAAGGCTGCCCCCTCGGTCACTCTGTTCCCACCCTCCTCTGAGGAG CTTCAAGCCAACAAGGCCACACTGGTCTGTGTCTCGTAAGTGACTTCAACCCGGA GCCGTGACAGTGGCCTGGAAGGCAGATGGCAGCCCCGTCAAGGTGGAGTGGA GACCACCAAACCCTCAAACAAAGCAACAACAAGTATGCGGCCAGCAGCTACCT GAGCCTGACGCCCGAGCAGTGGAAGTCCACAGAAGCTACAGCTGCCGGGTCAC GCATGAAGGGAGCACCGTGGAGAAGACAGTGCCCCTGCCCCAGAATGCTCT |
| 536 | | Cλ Light Chain Constant Region (IGLC7*03) Amino Acid Sequence | GQPKAAPSVTLFPPSSEELQANKATLVCLVSDFNPGAVTVAWKADGSPVKVGVETT KPSKQSNNKYAASSYLSLTPEQWKSHRSYSCRVTHEGSTVEKTVAPAECS |
| 537 | Human WT IgG1 constant region | IGHG1*01 & IGHG1*05 (IgG1) | WT human IgG1 nucleotide sequence #2 | gcctccaccaagggcccatcggtcttccccctggcaccctcctccaagagcacctctgggggcacagcgg ccctgggctgcctggtcaaggactacttccccgaaccggtgacggtgtcgtggaactcaggcgccctgac cagcggcgtgcacaccttcccggctgtcctacagtcctcaggactctactccctcagcagcgtggtgaccg tgccctccagcagcttgggcacccagacctacatctgcaacgtgaatcacaagcccagcaacaccaagg tggacaagaaagttgagcccaaatcttgtgacaaaactcacacatgcccaccgtgcccagcacctgaact cctgggggaccgtcagtcttcctcttccccccaaaacccaaggacaccctcatgatctcccggacccctg aggtcacatgcgtggtggtggacgtgagccacgaagaccctgaggtcaagttcaactggtacgtggacg gcgtggaggtgcataatgccaagacaaagccgcgggaggagcagtacaacagcacgtaccgggtgt cagcgtcctcaccgtcctgcaccaggactggctgaatggcaaggagtacaagtgcaaggtctccaacaa agcccctcccagccccatcgagaaaaccatctccaaagccaaagggcagccccgagaaccacaggtgt acaccctgcccccatcccgggatgagctgaccaagaaccaggtcagcctgacctgcctggtcaaggctt ctatcccagcgacatcgccgtggagtgggagagcaatgggcagccggagaacaactacaagaccacg cctcccgtgctggactccgacggctccttcttcctctacagcaagctcaccgtggacaagagcaggtggca gcaggggaacgtcttctcatgctccgtgatgcatgaggctctgcacaaccactacacgcagaagagcctc tccctgtctccgggtaaa |
| 538 | Human Cλ constant region | IGLC2*01 | Cλ Light Chain Constant Region Amino Acid Sequence #2-Encoded by nucleotide sequence version A & B | GQPKAAPSVTLFPPSSEELQANKATLVCLISDFYPGAVTVAWKADSPVKAGVETTT PSKQSNNKYAASSYLSLTPEQWKSHRSYSCQVTHEGSTVEKTVAPTECS |
| 539 | Human TIGIT-His/Flag | NCBI accession number NM_173799.3 Uniprot accession number Q495A1-1 Expressed protein corresponds to ECD only: Met 22-Pro 141 as per full length sequence Protein domains annotated: Campath leader (double line), extracellular domain (bold), linker & Flag/His tag (italic) | MGWSCIILFLVATATGVHSMMTGTIETTGNISAEKGGSTILQCHLSSTTAQV TQVNWEQQDQLLAICNADLGWHISPSFKDRVAPGPGLGLTLQSLTVND TGEYFCIYHTYPDGTYTGRIFLEVLESSVAEHGARFQIP *IEGRDYKDDDDKH HHHHH* |

SEQUENCE LISTING

| SEQ ID NO: | Name | Description | Sequence |
|---|---|---|---|
| 540 | Human TIGIT | Human TIGIT amino acid sequence NCBI accession number: NM_173799.3 Uniprot accession number: Q495A1-1 Protein domains annotated as follows: signal peptide (double line), extracellular domain (bold), transmembrane domain (italic) and cytoplasmatic domain (underlined) | MRWCLLLIWAQGLRQAPLASGMTGTIETTGNISAEKGGSTILQCHLSSTTA QVTQVNWEQQDQLLAICNADLGWHISPSFKDRVAPGPGLGLTLQSLTV NDTGEYFCIYHTYPDGTYTGRIFLEVLESSVAEHGARFQIPLLGAMAATLVV ICTAVIVVVALTRKKKALRIHSVEGDLRRKSAGQEMSPSAPSPGSCVQAEAAPAG LCGEQRGEDCAELHDYFNVLSYRSLGNCSFFTETG |
| 541 | Human TIGIT | Nucleotide sequence encoding human TIGIT NCBI accession number: NM_173799.3 | CGTCCTATCTGCAGTCGGCTACTTTCAGTGCAGAGAGGCCACATCTGCTTCC TGTAGGCCCTCTGGGCAGAAGCATGCGCTGGTGTCTCCTCCTGATCTGGGCCA GGGGCTGAGGCAGGCTCCCCTGCCTCAGAATGATGACAGGCACAGGCACCCA ACGGGGAACATTTCTGCAGAGAAGGTGGCTCATCATCTTACATGTCACCT CTCCTCCACCAGCCACAAGTGACCTGTCAACTGGGAGCCAGGACCAGCT TCTGGCCATTTGTAATGCTGACTTGGGGTGGCACCTCCAGTGCGCTGACCGTGAA CGATACAGGGGAGTACTTCTGCATCTATCACACCTACCCTGATGGGACGTACAC TGGGAAATCTTCCTGGAGTCCTAGAAAGCTCAGTGCTGTGGCACGGTGCCAG GTTCCAGATTCCATTGCTTGGAGCCATGGCCGACGCTGGTGGTCATCTGCAC AGCAGTTCATCGTGGTGCCGTTGACTAGAAAGAAGAAAGCCCTCAGAATCCA TTCTGTGGAAGGTGACCTCAGGAGAAAATAGCTGGACAGGAGGAATGGAGCC CCAGTGCTCCCTCACCCCAGGAAGCTGTCCAGGCAGAAGCTGCACCTGCTG GGCTCTGTGGGAGAGCAGCGCGGGGAGAGGACTGTGCCGAGCTGCATGACTACTTC AATGTCCTGAGTTACAGAGAAGCCTGGGTAACTGCAGCTCTTCTCACAGAGACTGGT TAGCAACCAGAGGACATTCTTCTGGAAGATAACACTTTTGTCTTTGCTATTATAGATG AATATATAAGCAGCTGTACTCCATCAGTGCTGCGTGCTGTGTGTGTGTGTA TGTGTGTGTGTGTTCAGTGAGTGAATAAATGTCATCCTTCTCCATCTTCATT TCCTTGGCCTTTTCGTTCTATTTCCATTTTGCATTATGCCAGGCCTAGGGTGAGT AACTGGGATCTTGATCATAAATGCAGAAATGCAAAATTAAAAATATCTTGACCTGGTTTTAA ATCTGGCAGTTTGAGCAGATCCTATGTCTCTGAGACACCATTCCTCATAATGG CCAGCATTTTGGGCTACAAGGTTTTGTGGTTAGCAGTTGCTGAGCAGGTGACTGC AGAGCCATCCATCTCATTTTTCACGTCATTTTCAGTAACTTTCACTCATTCAA AGGCAGGTTATAAGTAAGTCCTGGTAGCAGCCTCTATGGGAGATTTGAGAGTG ACTAAATCTTGGACTTGCCCTCAAGAACTTCAGTTAAATGGGAGAACAATGTT GTCATGAAAGGTATTATAGTAAGGAGGAGAGACATACACAGGCCTTCAGG AAGAGACGACAGTTTGGGGTGAGGTAGTTGGCATAGGCTTATCTGTGATGAAGT GGCCTGGGAGCACCAAGGGATGTTGAGGCTAGTCTGGGAGGAGGAGAGTTT TGTCTAGGGAACTTGTAGGAAATTCTTGAGCTGAAAGTCCACAAAGAAGGCC CTGGCACCAAGGGAGTCAGCAAACTTCAGATTTTATTCTCGGCAGGCATTTC AAGTTTCCTTTTTGCTGTGACATACTCATCCATTAGACAGCCTGATACAGGCCTGT AGCCCTCTTCCGCCGTCTGTCTGGGAAGCCCAGGAAACGCACATGCCACA CAGGGAGCCAAGTCGTAGCATTTGGGCCTTGATCTACCTTTTCTGCATCAATAC ACTCTTGAGCTTTGAAAAGAACTTTCCCACTAAAGAACTTTCTGATTTT |

| SEQ ID NO: | Name | Description | Sequence |
|---|---|---|---|
| | | | TAAAATAGGGACTCTTCCTAGGGAAAAAGGGGCTGGGAGTGATAGAGGGT |
| | | | TTAAAAATAAACACCTTCAAACTACTTCTTCGAACCCTTTTATTCACTCCCTGA |
| | | | CGACTTTGCTGGGTTGGGTAACTGAACCGCTTATTTCTGTTTAATTGCAT |
| | | | TCAGGCTGGATCTTTAGAAGACTTTTATCCTTCCACCATCTCTCAGAGGAATGA |
| | | | GCGGGGAGGTGGATTTACTGGTGACTGATTTCTTCTTGCCAAGGAACTG |
| | | | AAAGAGAATGTGAAGCAAGGTTGTGTCTTGCGCATGGTAAAAATAAAGCATTG |
| | | | TCCTGCTTCCAAGACTTAGACTGGGGTTGACAATTGTTTTAGCAACAAGACAAT |
| | | | TCAACTATTTCTCCTAGGATTTTATTATTATTATTTCACTTTTCTACCAAAT |
| | | | GGGTTACATAGGAAGAAGAATGAACTGAAATCTGTCCAGAGCTCCAAGTCCTTTGA |
| | | | AGAAAGATTAGATGATGAACGTAAAAATGTTGTTGTCTGTGGCAGTTTACAGCA |
| | | | TTTTCTTGCAAAATTAGTGCAAATCTGTTGGAAATAGAACACAATTCACAAATT |
| | | | GGAAGTGAACTAAAAATGTAATGACAGAAAAGGGAGTAGTGTTTTGATTTGGAGGA |
| | | | GGTGTATATTCGGCAGAGGTTGGACTGAGAGTTGGGTGTTATTTAACATAATTA |
| | | | TGGTAATTGGGAAACATTTATAAAACTATTGGGATGGTGATAAAATACAAAAG |
| | | | GGCCTATAGATCGTTAGAGAAATGGTCAGGTTACTGAAATGCCTATCCACCAGTAGCCACTT |
| | | | AAAATTTTTAAATAGAACTCACTGAACTAGAATTCTCCTGAGAACCAGAGAA |
| | | | GACCATTTCATAGTTCGATTCTCAACCACTATAAGATGGGTTAGTTTAAATCAAGATGTGC |
| | | | TCCACATGTGGCCATCACCACCACTTAAGATGGGTTAGTTTAAATCAAGATGTGC |
| | | | TGTTATAATTGGTATAAGACATAAAATCACACTAGAATTCTGAGATTTAATATGAA |
| | | | TAATAGAATACTATTTCAGTAGTTTGGTATATTGTGTCTCAAAAATGATAATA |
| | | | TTTTGGATGTATTGGGTGAAATAAAATATTAACATTAAAAAAAAA |
| 542 | Human TIGIT | Human TIGIT optimised nucleotide sequence encoding human TIGIT extra cellular domain. Annotated as follows: Campath leader (double line) NCBI accession number: NM_173799.3 | <u>ATGGGCTGGTCCTGCATCATCCTGTTTCTGGTGGCCACAGCCACCGGCGTGCAC</u><br><u>AGCATGATGACCGGCACCATCGAGACCAACATCGGCGACAACATCAGCGCCGAGAAGGGC</u><br>GGCTCTTATCATCCTGCAGTGCCACCTGAGCCGCAGCAGCACCACCGCCAAGTGACCCAA<br>GTGAACTGGCAGCAGGATCGCTGCTGCCATCTGCAACGCGCCATCTGGG<br>CTGGCCACATCAGCGCCCCAGCTTCAAGGACAGAGTGGCCCTGGACCTGGCCTGGG<br>ACTGACACTGCAGAGCCTGACCGTGAACGATACCGGCCGAGTACTTCTGCATCTA<br>CCACACTACCCCGACGGCACCTATACCGGCCGGATCTTCCTGGAAGTGCTGGA<br>AAGCAGCGTGGCCGAGCACGGCCCAGATTCCAGATCCCT |
| 543 | Human TIGIT | Human TIGIT optimised nucleotide sequence encoding human TIGIT full length NCBI accession number: NM_173799.3 | ATGAGGTGGTGTCTGCTGCTGATCTGGGCTCAGGGCTGCAGGACAGGCCCTCT<br>GGCTAGCGGAATGATGACCGGCACCATCGAGACAACATCGGCGACAACATCAGCGCCGA<br>GAAGGGCGGCAGCATCATCCTGCAGTGTCACCTGAGCAGCAGCACCACCGCACAGT<br>GACCCAAGTGAACTGGGAGCAGCAGGATCAGCTGCTGGCCATCTGTAACGCTGA<br>CCTGGGCTGGCACATCAGCCCCAGCTTCAAGGACAGAGTGGCTCCTGGCCCTGG<br>CCTGGGACTGACTCTGCAGTCTCTGACCGTGAACGATACCGGCAGTACTTCTG<br>CATCTACCACACCACCCCGACGGCACCTATACCGGCAGAATTCCTCTGGAAGTG<br>CTGGAAAGCAGCGTGGCCGAGCACGGCCCAGATTCCAGATCTGTCCTCTGGGC<br>GCCATGGCCGCCACACTGGTCTGCGTGCTGCTGTACCGCCGTGATCGTGGTGGCC<br>CTGACCAGAAGAAGAAGGCCCTGCGGATCCACAGCGTGGAAGGCGACCTGAG<br>AAGAAAGTCTGCCGGCTGAGGAAGAGTGGTCCTGCGCTCCAAGCCCTCCTGG<br>CTCTTGTGTGCCAGGCTGAGCGTGCCTCCTGCGTGCTGTGGCGAACAGAGAG<br>GCGAGGATTGCCGAGCTGCCGACTACTTCAACGTGCTGAGCTACAGAGCC<br>TGGGCAACTGCCAGCTTCTTCACCGAGACAGGC |

-continued

SEQUENCE LISTING

| SEQ ID NO: | Name | Description | Sequence |
|---|---|---|---|
| 544 | Human TIGIT | Human TIGIT (alternative isoform) amino acid sequence Uniprot accession number: Q495A1-2 Differs from Seq ID No: 540 167-170: KKAL → FVCF 171-244: Missing. Protein domains annotated as follows: Signal peptide (double line), extracellular domain (bold), transmembrane domain (italic) and cytoplasmatic domain (underlined) | MRWCLLLIWAGLRAPLASGMMTGTIETTGNISAEKGGSIILQCHLSSTTA QVTQVNWEQQDQLLAICNADLGWHISPSFKDRVAPGPGLGLTLQSLFTV NDTGEYFCIYHTYPDGMGRIFLEVLESSVAEHGARFQIPLLGAMAATLW ICTAVIVVVALTRKFVCF |
| 545 | Human TIGIT-Fc | Human TIGIT-Fc amino acid sequence NCBI accession number: NM_173799.3 Uniprot accession number: Q495A1-1 Protein domains annotated as follows: Campath leader (double line), extracellular domain (Met 22-Pro 141 as per full length sequence) (bold), linker and Fc (italic) | MGWSCIILFLVATATGVHSMMTGTIETTGNISAEKGGSIILQCHLSSTTAQV TQVNWEQQDQLLAICNADLGWHISPSFKDRVAPGPGLGLTLQSLTVND TGEYFCIYHTYPDGTYTGRIFLEVLESSVAEHGARFQIP IEGREPKSCDKTH TCPPCPAPELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKALPAPIEKTI SKAKGQPREPQVYTLPPSRDELTKNQVSLTCLVKGFYPSDIAVEWESNGQPENNYK TTPPVLDSDGSFFLYSKLTVDKSRWQQGNVFSCSVMHEALHNHYTQKSLSLSPGK |
| 546 | Human TIGIT-Fc R&D, Catalogue number 7898-TG | Human TIGIT-Fc amino acid sequence NCBI accession number: AAI01289 Extracellular domain (Met 22-Pro 141 as per full length sequence) (bold), linker and Human IgG1 Fc (Pro100Lys330) (italic) | MMTGTIETTGNISAEKGGSIILQCHLSSTTAQVTQVNWEQQDQLLAICN ADLGWHISPSFKDRVAPGPGLGLTLQSLTTAQVTVNDAGEYFCIYHTYPDGTYT GRIFLEVLESSVAEHGARFQIP IEGRMDPKSCDKTHTCPPCPAPELLGGPSVFLF PPKPKDTLMISRTPEVICVVVDVSHEDPEVKFNWYVDGVEVHNAKTKPREQYNS TYRWSVLTVLHQDWLNGKEYKCKVSNKALPAPIEKTISKAKGQPREPQVIPTLPPSR DELTKNQVSLTCLVKGFYPSDIAVEWESNGQPENNYKTTPVLDSDGSFFLYSKLT VDKSRWQQGNVFSCSVMHEALHNHYTQKSLSLSPGK |
| 547 | Cyno TIGIT | Cyno TIGIT amino acid sequence NCBI accession number: Transcript variant X4 XP_005548160.1 | MRWCLFLIWAQGLRQAPLASGMMTGTIETTGNISAKKGGSVILQCHLSSTMAQVT QVNWEQHDHSLLAIRNAELGWHIYPAFKDRVAPGPGLGLTLQSLTMNDTGEYFCT YHTYPDGTYRGRIFLEVLESSVAEHSARFQIPLLGAMAMMLVVICIAVIVVVLARKK SLRIHSVESGLQRKSTGQEEQIPSAPSPPGSCVQAEAAPAGLCGEQQGDDCAELHD YFNVLSYRSLGSCSFFTETG |

| SEQ ID NO: | Name | Description | Sequence |
|---|---|---|---|
| 548 | Cyno TIGIT | Nucleotide sequence encoding cyno TIGIT NCBI accession number: Transcript variant X4 XM_005548103.1 | CTCCTGCTGCAGGATGTTGCCCTTGTTCGAGGCAGGAGACAGGAGGCCTCAGACA GCTGTGACAGCCCTGGAGCTCTTCCTACCACATTCGAGCCAGAGGGAAGACTTTG GAGAAGCAGAAGCCCAAAGACACTGCTGGGAGATTGGTCGTGCTCTGGAGGA ACCCTAGGTTGTGTTTCCCGTGTACAAGTCACGGATCTTCTGAAGGTACCACC GCTCCAGCCCGCTTGGCTGAGGGCTGAGGGCCACAGGTTTTTCGGGACTGTG CCTGTGTTGGAGGCTGTGGACTCAAGCTCAGTTTTACCGTCCTATCTGCAGTC GGCTACTTTCGGTGGCAGAAGAGGCCACATCTGCTTCCTGTAAGCCCTCTGGGC AGAAGCATGCCGTGGTGTCTTCTTCCTGATCTGGGCCCAGGGCTGAGGCAGGC TCCCCTCGCCTCAGGAATGATGACAGGCACAATAGAAACAACGGGGAACATTTC TGCAAAGAAAGTGGCTCTGTTARTTACACATGTCACCTCTCCTCCACCATGGCA CAAGTGACCCAGGTCAACTGGGAGCAGCAGCCATGACCCATTCGCTTCTGCCATTCGT AATGCTGAGTTGGGGTGGCACATCTACCCAGCCTTCGACCATGAATGATACAGGGGAG GTCCTTGGCCTGGCTCACCCTCAGTGGCTGAGCACAGTGCCAGGTTCCAGATTTCCAT TACTTCTGCACCATCACCCCTGATGGGACTATAGCAGCAGTCATCGTGG TGCTTGGAGCATGGCCATGACTGGTGCTAGCAGTGATCTGCATAGCAGTCATCGTGG GGTCTGTGTTGGACTAGAAAGAATCCTCAGAATCCATTCTGTGAAAGTGGCC TCCAGAGAAAATCAACTGGACAGAAGAACAGATTCCAGGTCCTCCTCACCCC CAGGAAGCTGTGTCCAGGCAGAAGCTGCACCTGCTGGGCTCTGTGGAGAGCAG CAGGAGATGACTGTGCCGAGCTGCTTCTTCACAGAGACTGGGTAGCAAACAGAGGCATGT TCTGGAAGATAACACTTTTGCTCTTGACTATTATAGATGTCTTGACTAATATATAAA CAGCTGTATTCGCCATCAGTGTGCGCGCCGTGTGTGTTCAGTTGAGTGAATAA ATGTCATCCTCTTCTA |
| 549 | Cyno TIGIT | Cyno TIGIT amino acid sequence NCBI accession number: Transcript variants X1: XM_005548100.1 X2: XM_005548101.1 X3: XM_005548102.1 | MRWCLFLIWAQGLRQAPLASGMMTGTETTGNISAKKGGSVILQCHLSSTMAQVT QVNWEQHDHSLLAIRNAELGWHIYPAFKDRVAPGPGLGLTLQSLTMNDTGEYFCT YHTYPDGTYRGRIFLEVLESSVAEHSARFQIPLLGAMAMMLVVICIAVIVVVLARKK KSLRIHSVESGLQRKSTGQEEQIPSAPSPGSCVQAEAAPAGLCGBQQGDDCAELH DYFNVLSYRSLGSCSFFTETG |
| 550 | Cyno TIGIT | Nucleotide sequence encoding cyno TIGIT NCBI accession number: Transcript variant X1: XM_005548100.1 | CCTGCTGCAGGATGTTGCCCTTGTTCGAGGCAGGAGACAGGAGGCCTCAGACAGC TGTGACAGCCCTGGAGCTCTTCCTACCACATTCGAGCCAGAGGGAAGACTTTGGA GAAGCAGAAGCCCAAAGACACTGCTGGGAGATTGGTCGTGCTCTGGAGAACC CTAGGTTGTGTTTCCCGTGTACAAGTCACGGATCTTCTGAAGGTACCACCGCT CCAGCCCGCTTGGCTGAGGGCTGAGGGCCACAGGTTTTCGGGACTGCCT GTGGTTGGAGGCTGTGGACTCAAGCTCAGTTTTACCGTCCTATCTGCAGTCGGC TACTTTCGGTGGCAGAAGAGGCCACATCTGCTTCCTGTAAGCCCTCTGGGCAGA AGCATGCCGTGGTGTCTTCCTGATCTGGGCCCAGGGCTGAGGCAGGCTCC CCTCGCCTCAGGAATGATGACAGGCACAATAGAAACAACGGGGAACATTTCTGC AAAGAAAGTGGCTCTGTTATCTTACACATGTCACCTCTCCTCCACCATGGCACAA GTGACCCAGGTCAACTGGGAGCAGCATCCCAGCCTTCGCTTCTGCCCATTCGTAAT GCTGAGTTGGGGTGGCACATCTACCCAGCCTTCAAGGATCGAGTGCCCCGGT GCTGGGCCTGGCCTACCCTCAGTGCTGACATGAATGATACAGGGGAGTAC TTCTGCACCTATCACCTACCCTGATGGGACTTACAGAGGGAGAATCTTCCTG |

SEQUENCE LISTING

| SEQ ID NO: Name | Description | Sequence |
|---|---|---|
| | | GAGGTCCTAGAAAGC |
| | | TCAGTGGCTGAGCACAGTGCCAGGTTCCAGATTCCATTGCTTGGAGCCATGGCC |
| | | ATGATCGTGGTCATCTGCAAGTCCATAGCAGTCATCGTGGTGCGTGTTGGCTAGA |
| | | AAGAAGAAATCCCTCAGAATCCATTCTGTGACAGTGGCTTCCAGAGAAGCTGTGT |
| | | ACTGGACAGGAAGAACAGATTCCCAGTGCTTCCCCACCCCAGGAAGCTGTGTC |
| | | CAGGCAGAAGCTGCACCTGGCTTGGGCTGTGAGGAGAGCAGCAGGGAGATGACTG |
| | | TGCCGAGCTGCATGACTACTTCAATGTCCTGAGTTACAAGAAGCCTGGGAGCTG |
| | | CAGCTTCTTCACAGAGACTGGTAGCAAACAGAGGCATGTTTCTGAAGATACAC |
| | | TTTGTCTTGACTATTATAGATGTCTTGACTAATATAAACAGCTGTATTCGCC |
| | | ATCAGTTGCGCCGCGTGTGTTCAGTTGAGTGAATAAATGTCATCCTCTC |
| | | TCTA |
| 551 Cyno TIGIT | Nucleotide sequence encoding cyno TIGIT NCBI accession number: Transcript variant X2: XM_005548101.1 | CCTGCTGCAGGATGTTGCCTTGTTCGAGGCAGAGAGACAGGAGGCCTCAGACAGC |
| | | TGTGACAGCCCTGGAGCTCTCCTACCACATCTGAGCCAGGAGGAAGACTTTGGA |
| | | GAAGCAGAAGCCCAAAGACACTGCTGGGAGATTGGTCTGTCTCTGGGAGAACC |
| | | CTAGGTTGTGTTTCCCGTGTACAAGTCACGGATCTTCTGGAAGGTCAGTTTA |
| | | CCGTCCTATCTCAGTCGGCTACTTTCGGTGGTCAGAAGAGCCACATCTGCTTC |
| | | CTGTAAGCCCTCTGGGCAGAAGCATGCGGTGGTGTCTTCCTGATCTGGGCCC |
| | | AGGGGCTGAGGCAGGCTCCCCTCGCCTCAGGAAGGTGGCTCTGTTATCTTACAATAGAAA |
| | | CAACGGGAACATTTCTGCAAAGAAAGGTGGCTCAAGGTAGCAGCATGATCACC |
| | | TCTCCTCCCATGGCACAAGTGACCCAGTGAACTGGAGCCAGCATGACCATT |
| | | CGCTTCTGGCCATTCTAATGCTGAGTTGGGGTGGCACCCCAGCCTTCA |
| | | AGGATCGAGTCGCCCGGGTCCTGGCCTGCACCCTCTACCCTGCTGACCA |
| | | TGAATGATAACAGGGGAGAATCTTCCTGGAGGTCCTAGAAAGCTCAGTGGCTACAGTG |
| | | ACAGGAGAGATCTTCCATTGCTTGAGGAGCAGTGGCTGACGCATGGCTGGTCATCT |
| | | CCAGGTTCCAGATTCCATTGCTTGGAGCCATGGCCATGATCGTGGTCATCC |
| | | GCATAGCAGTCATC |
| | | GTGGTGGTCGTGTTGGCTAGAAAGAAGAATCCCTCAGAATCCATTCTGTGGAA |
| | | AGTGGCCTCCAGAGAAGCAACTGGACAGGAAGAACAGATTCCCAGTGCTCCC |
| | | TCACCCCCAGGAAGCTGTGTCCAGGCAGAAGCTGCACCTGGGCTGTGGA |
| | | GAGCAGCAGGGAGATGACTGTGCCGAGCTGCATGACTACTTCAATGTCCTGAGT |
| | | TACAGAAGCCTGGGAGCTGCAGCTTCTTCACAGAGACTGGTAGCAAACAGAG |
| | | GCATGTTCTGAAGATACACTTTGTCTTGACTATTATAGATGTCTTGACTAATA |
| | | TATAAACAGCTGTATTCGCCATCAGTTGCGCCGCGTGTGTTCAGTTGAGT |
| | | GAATAAATGTCATCCTCTTCTA |
| 552 Cyno TIGIT | Nucleotide sequence encoding cyno TIGIT NCBI accession number: Transcript variant X3: XM_005548102.1 | TCCTGCTGCAGGATGTTGCCCTTGTTCGAGGCAGAGAGACAGGAGGCCTCAGACAG |
| | | CTGTGACAGCCCTGGAGCTCTCCTACCACATCTGAGCCAGGAGGAAGACTTTGG |
| | | AGAAGCAGAAGCCCAAAGACACTGCTGGGAGATTGGTCTGTCTCTGGGAGAAC |
| | | CCTAGGTTGTGTTTCCCGTGTACAAGTCACGGATCTTCTGGAAGGTACCACCGC |
| | | TCCCAGCCCCGCCTTGGCTGAGGGCTGAGGCTCAAGGTTTACCGTCCTATCTCAGTGCCT |
| | | GGGTTGGAGCCTGTGGACTCAAGCTCAGTTTTACCGTCCTATCTCAGTCGGC |
| | | TACTTTCGGTGCAGAAGAGCCACATCTGCTTCCTGTAAGCCCTCTGGCAGA |
| | | AGCATGCGGTGGTGTCTTCCTGATCTGGGCCCAGGGGCTGAGGCAGGCTCC |
| | | CCTCGCCTCAGGAATGATGACCAGGCACAATAGAAACAACGGGAACATTTCTGC |
| | | AAAGAAAGGTGGCTCTGTTATCTTACAATGTCACCTCTCCTCCACCATGGCACAA |
| | | GTGACCCAGTCAACTGGGAGCAGCATGACCATTCGCTTCTGGCCATTCGTAAT |

| SEQ ID NO: | Name | Description | Sequence |
|---|---|---|---|
| | | | GCTGAGTTGGGTGGCACATCTACCCAGCCTTCAAGGATGAGTGCCCCGGGT |
| | | | CCTGGCCTGGGCCTCACCTGCCATGTGCCTGATGAATGATACAGGGGAGTAC |
| | | | TTCTGCACCTATCACACCACCTACCCTGATGGACTTACAGAGGGAGAATCTTCCTG |
| | | | GAGGTCCTAGAAAG |
| | | | CTCAGTGGCTGAGCACAGTGCCAGGTTCCAGATTCCATTGCTTGGAGCCATGGC |
| | | | CATGATGCTGGTGGTCATCTGCATAGCAGTGCATCGTGGTGTGTTGGCTAG |
| | | | AAAGAGAAATCCCTCAGAATCCATTCTGTGGAAAGTGGCCTCCAGAGAAATC |
| | | | AACTGGACAGGAAGAACAGATTCCCAGTGCTCCCAGTCCCCAGGAAGCTGTGT |
| | | | CCAGGCAGAAGCTGACCTGCTGGGCTCTGTGGAGGACAGCAGGGAGATGACT |
| | | | GTGCCAGCTGCATGACTACTTCAATGTCCTGAGTTACAGAAGCTGGGGAGCT |
| | | | GCAGCTTCTTCACAGAGACTGGGTAGCAAACAGAGAACTCACTGAACTAGATTC |
| | | | TCCTCTGAGGACCAGAGAAGACCATCTCATAGCTGATTCCTGAGACATGCAC |
| | | | TGTCCACGCGTAGCCACTTTCCACGTGTGGCCATCAACCACTTAAGATGGGGTT |
| | | | AGTTTAAATCAAGATGTG |
| 553 | Cyno TIGIT | Cyno TIGIT optimised nucleotide sequence for expression of Cyno TIGIT extracellular domain annotated as follows: Campath leader (double line) | ATGGGCTGGTCCTGCATCATCCTGTTCTGTGGCCACAGCCACCGGCGTGCAC <br>AGCATGATGACCGGCACCATCGAGACACAACCGCAACATCAGCGCCAAGAAGGC <br>GGCAGCGTGATCCTGCAGCTGTCTAGCACCATGGCCCAAGTGACCCAA <br>GTGAACTGGGAGCAGCACGACAGCCTGCTGGCCATCAGAAATGCCGAGCTG <br>GGCTGGCACATTCTACCCGCCTTCAAGGACAGAGTGGCCCCTGACCTGGCCTG <br>GGACTGACACTGCAGAGCCTGACCATGAACGATACGGGGAGTACTTCTGCACC <br>TACCACCATCCCCGACGCGACCTACCGGGGCAGAATCTTCTCGAAGTGCTG <br>GAAAGCAGCGTGGCCCGAGCACAGCGCCAGATTCCAGATCCCC |
| 554 | Cyno TIGIT-Flag/His | Cyno TIGIT-Flag/His amino acid sequence NCBI accesstion number: XP_005548160.1 Protein domains annotated as follows: Campath leader (double line), extracellular domain (Met 22-Pro 142 as per full length sequence) (bold), linker and Flag/His tag (italics) | MGWSCIILFLVATATGVHSMMTGTIETTGNISAKKGGSVIILQCHLSSTMAQVTQVN <br>WEQHDHSLLAIRNAELGWHIYPAFKDRVAPGLGLTLQSLTMNDTGEYFCTYHT <br>YPDGTYRGRIFLEVLESSVAEHSARFQIPIEGRDYKDDDDKHHHHHHH |
| 555 | Cyno TIGIT-Fc | Cyno TIGIT-amino acid sequence NCBI accession number: XP_005548160.1 Protein domains annotated as follows: Campath leader (double line), extracellular domain (Met 22-Pro 142 as per full length sequence) (bold), linker and Fc (italics) | MGWSCIILFLVATATGVHSMMTGTIETTGNISAKKGGSVIILQCHLSSTMAQVTQVN <br>WEQHDHSLLAIRNAELGWHIYPAFKDRVAPGLGLTLQSLTMNDTGEYFCTYHT <br>YPDGTYRGRIFLEVLESSVAEHSARFQIPIEGREPKSCDKTHTCPPCPAPELLGGPSV <br>FLFPPKPKDTLMISRTPEVTCVVVDVSHEDPEVKFNWYVDGVEVHNAKTKPREEQY <br>NSTYRMSVLTVLHQDWLNGKEYKCKVSNKALPAPIEKTISKAKGQPREPQVYTLP <br>PSRDELTKNQVSLTCLVKGFYPSDIAVEWESNGQPENNYKTTPPVLDSDGSFFLYS <br>KLTVDKSRWQQGNVFSCSVMHEALHNHYTQKSLSLSPGK |

-continued

SEQUENCE LISTING

| SEQ ID NO: Name | Description | Sequence |
|---|---|---|
| 556 Mouse TIGIT | Mouse TIGIT amino acid sequence NCBI accession number: NP_001139797.1 | MHGWLLLVWVQGLIQAAFLATGATAGTIDTKRNISAEEGGSVILQCHFSSDTAEVT QVDWKQQDQLLAIYSVDLGWHVASVFSDRVVPGPSLGLTFQSLTMNDTGEYFCT YHTYPGGIYKGRIFLKVQESSVAQPQTAPLGGTMAAVLGLICLMVTGVTVLARKKSI RMHSIESGLGRTEAEPQEWNLRSLSPGSPVQTQTAPAGPCGEQAEDDYADPQEY FNVLSYRSLESFIAVSKTG |
| 557 Mouse TIGIT | Nucleotide sequence encoding mouse TIGIT NCBI accession number: EU675311.1 | GCCAGTTTCAGTTGAGGAGGAGGCCACATCCACTTTGCTGTAGGCCTCTGTTA GAAGCATGCATGGCTGCTCTGTCCTGGTTCTGGGTCAGGGCTGATACAGCT GCCTTCCTCGCTACAGGACGCACAGCAGGCACGATAGATACAAAGAGGAACATC TCTGCAGAGGAAGGTGCTCTGTCATCTTACAGTGTCACTTCTCCTGACACA GCTGAAGTGACCCAAGTGCACTGGAAGCAGGACCCAGCTTCTGGCCATTTAT AGTGTTGACCTGGGGTGGCATGTCGCTTCAGTCTTCAGTGATCGGGTGGTCCA GGCCCCAGCCTAGGCCTCACCTTCCAGTCTCTGACAATGAATGACACGGAGAG TACTTCTGTACCTATCATACGTATCCTGGGGATTTACAAGGGAGAATATTCC TGAAGGTCCAAGAAAGCTCAGTGGCTCATTTGCTTAATGTCACAGGAGTGACTGTAC CCATGCTGCTGTGCTGGGACTCATTTGCTTAATGTCATAGAAAGTGGGCTTGGGAGAA CAGAAGCGGAGCCACAGGAAATGGAACCTGAGGAGTCTCTCATCCCCTGAAGCC CTGTCCAGACACAACAAACTGCCCCTGGTCCCTGTGGAGAGCAGGCAGAAGATG ACTATGCTGACCCACAGGAATACTTTGAAGACTGGCTAACGACAGCTCTTATCCCTCCCTAT GTCTCTCTCTCTCTCTCTCTCTCTCTCTCTCTCTCTCTCTCTCTCTCTGTCTC TCTCTCTCTCTCTTCATTAACACTAACTGCATATGTGGAGGACCAGAATAAAAGTT CATTAATGTTCATTAACACTAACTGCATATGTGGAGGACCAGAATAAAAGTT TGTGTTGCTAATAAAATTAAGTGCTAACTT |
| 558 Mouse TIGIT | Mouse TIGIT optimised nucleotide sequence NCBI accession number: EU675311.1 | ATGCACGGATGGCTGCTGCTGGTGTGGGTGCAGGGACTGATCCAGGCCGCTTT TCTGGCCACCGGCGCCTACAGCGTGGACCATCGACACCAAGAGAAACATCAGCGC CGAAGAGGGCGGCAGCGTGATCCTGCAGTGCCACTTCAGCAGCGACACCGCCGA AGTGACCCAGGTGGACTGGAAGCAGCAGGACCAGCTGCTGGCCATCTACAGCGT GGACCTGGGCTGGCATGTGGCCAGCGTGTTCAGCGACAGAGTGGTGCCTGGCC CTAGCCTGGGCCTGACATTCCAGAGCCTGACCATGAACGATACCGGCGAGTACT TCTGCACCTACCACACCTACCCTGGCGGCATCTACAAGGGCAGAATCTTCCTGAA GGTGCAGGAATCCAGCGTGGCCCAGTTCCAGACAGCTCCTCTGGGCGGCACAAT GGCCGCTGTGCTGGGCCTGATCTGCCTGATGGTCACCGGCGTGACAGTGCTGG CCCGGAAGAAATCCATCAGAATGCACAGCATCGAGTCCGGCCTGGGCAGAACAG AGGCCGAGCCTCAGGAATGAACCTGAGAAGCCTGAGCCCTTGTGGCGAGCAGGCCGAGGATGA GTGCAGACACAGACATCAGGAATGAACCTGAGAAGCCTGAGCCTTGTGGCGAGCAGGCCGAGGATGA TTACGCCGACCCCCAGGAATACTTCAACGTGCTGAGCTACAGAAGCCTGGAATC CTTTATCGCCGTGTCCAAGACCGGC |

SEQUENCE LISTING -continued

| SEQ ID NO: | Name | Description | Sequence |
|---|---|---|---|
| 559 | Mouse TIGIT | Mouse TIGIT amino acid sequence Uniprot accession number: P86176-1 Protein domains annotated as follows: signal peptide (double line), extracellular domain (bold), transmembrane domain (italic) and cytoplasmatic domain (underlined) | MHGWLLLVWVQGLIQAAFLATAIGATAGTIDTKRNISAEEGGSVILQCHFSSD TAEVTQVDWKQQDQLLAIYSVDLGWHVASVFSDRVVPGPSLGLTFQSLT MNDTGEYFCTYHTYPGGIYKGRIFLKVQESSDDRNGLAQFQTAPLGGTM AAVLGLICLMVTGVTVLARKDKSIRMHSIESGLGRTEAEPQEWNLRSLSSPGSPVQ TQTAPAGPCGEQAEDDYADPQEYFNVLSYRSLESFIAVSKTG |
| 560 | Mouse TIGIT-His Sino Biological 50939-M08H | Mouse TIGIT-His amino acid sequence NCBI accession number: NP_001139797.1 Expressed protein Met 1-Gly 141 as per full length sequence | MHGWLLLVWVQGLIQAAFLATAGATAGTIDTKRNISAEEGGSVILQCHFSSDTAEVT QVDWKQQDQLLAIYSVDLGWHVASVFSDRVVPGPSLGLTFQSLTMNDTGEYFCT YHTYPGGIYKGRIFLKVQESSVAQFQTAPLG |
| 561 | Mouse TIGIT-Fc Sino Biological 50939-M02H | Mouse TIGIT-Fc amino acid sequence NCBI accession number: NP_001139797.1 Expressed protein Met 1-Gly 141 as per full length sequence | MHGWLLLVWVQGLIQAAFLATAGATAGTIDTKRNISAEEGGSVILQCHFSSDTAEVT QVDWKQQDQLLAIYSVDLGWHVASVFSDRVVPGPSLGLTFQSLTMNDTGEYFCT YHTYPGGIYKGRIFLKVQESSVAQFQTAPLG |
| 562 | Mouse TIGIT-Fc R&D, Catalogue number 7267_TG | Mouse TIGIT-Fc Amino acid sequence NCBI accession number: NP_001139797 Expressed protein Gly26-Thr 143 (bold) as per full length sequence Linker and mouse IgG2a Fc tag (Glu98-Lys330) (italic) | GTIDTKRNISAEEGGSVILQCHFSSDTAEVTQVDWKQQDQLLAIYSVDL GWHVASVFSDRVVPGPSLGLTFQSLTMNDTGEYFCTYHTYPGGIYKGRI FLKVQESSVAQFQTAPLGGT*IEGRMDPEPRGPTIKPCPPCKCPAPNLLGGPSVFI FPPKIKDVLMISLSPIVTCVVVDVSEDDPDVQISWFVNNVEVNTAQTQTHREDYNS TLRWSALPIQHQDWMSGKEFKCKVNNKDLPAPIERTISKPKGSVRAPQVVLPPP EEEMTKKQVTLTCMVTDFMPEDIYVEWTNNGKTELNYKNTEPVLDSDGSYFMYSK LRVEKKNWVERNSYSCSVMHEGLHNHHTTKSFSRTPGK* |

SEQUENCE LISTING

| SEQ ID NO: | Name | Description | Sequence |
|---|---|---|---|
| 563 | Human CD155 | Human CD155 amino acid sequence NCBI accession number: NM_006505.4 Protein domains annotated as follows: signal peptide (double line), extracellular domain (bold), transmembrane domain (italic) and cytoplasmatic domain (underlined) | MARAMAAWPLLLVALLVLSWPPPGTGDVVVQAPTQVPGFLGDSVTLPCYL QVPNMEVTHVSQLTWARHGESGSMAVFHQTQGPSYSESKRLEFVAARL GAELRNASLRMFGLRVEDEGNYTCLFVTFPQGSRSVDIWLRVLAKPQNT AEVQKVQLTGEPVPMARCVSTGGRPPAQITWHSDLGGMPNTSQVPGFL SGTVTVTSLWILVPSSQVDGKNVTCKVEHESFEKPQLLITVNLTVYYPPEV SISGYDNNWYLGQNEATLTCDARSNPEPTGYNWSTTMGPLPPFAVAQG AQLLIRPVDKPINTTLICNVTNALGARQAELTVQVKEGPPSEHSGMSRNA IIFLVLGILVFLILLGIIFYWSKCSREVLMHCHLCPSSTEHASASANGHVSYSAVS RENSSQDPQTEGTR |
| 564 | Human CD155 | Nucleotide sequence encoding human CD155 NCBI accession number: NM_006505.4 | AGCGGGACTGAGCGCCGGAGAGAACCTGCCAGGCCCAGGCGCGCGGAGG GCCAGCCTGGGTGGCCCACCCGCCTGGCGGACTGGGCTGGCCGCCAACTCCCCTC CGCTCCAGTCACTTGTCTGGAGCTTGAAGAAGTGGGTATTCCCTTCCCACCCC AGGCACTGGAGGAGCGGCCCCCGGGGATTCCAGAACCTGAGCTCCGGGAGCT GGACTCCCAGCGACCCGCCAGAGCGAGCGAGCGGACGCGGGAAGCGAGGAGACGC CCGCGGAGGCCCAGCTGCTCGGAGCAACTGGCATGGCCCGAGCCATGGCCGC CGCGTGGCCGCTGCTGTCGTGCTGGCCCACCCAGTGCCGTCCTGGCCACCCAG GAACCGGGACTGCTGTCGTGACCGCCACCTACAGGTGCCCAACATGGAGGTGACGAT GTGTCACAGCTGACTTGGCGCGGCATTGGCCGGCATGTGAATCTGCAGCATGCCGTCTTC CACCAAACGCAGGGCCCCAGTATTCGCGAATGCTCGCTGGAGTCCAAACGGCTGGAATTCGTGGCA GCCAGACTGGGCGCGGAGCTGCCGAGCTCCGTGAGGATGTTCGGGTTGCG CAGGAGGATGAAGGCAACTACACCTGCCTGTTCGTCACGTTCCCGCAGGCAG CAGGAGCCGTGGATATCTGGCTGCGCAAGCCCCAGAACACAGCTGA GGTTCAGAAGGTCCAGTCACTGGAGCCCAGTGCCCATGCCCGCCGTCGTCTC CACAGGGGGTCGCCCCGCAGCCCCAAATCACCTGGCACTCCAGACCTGGCGGGAT GCCAATACCAGAGCCAGGTGCCAGGGTTCCTGTCTGGCACAGTCACTGTCACCAG CCTTCTGGATATTGGTGCCCTCAAGCCAGGTGACGGCCAAGGATGTGACCTGCAA GGTGGAGCACAGAGAGCTTTGAGAAGCCTCAGCTGCTGCTGACTGTGAACCTCACCGT GTACTACCCCCCAGAGGTATCCATCTCTGGCTATGATAACAACTGGTACCTTGGC TATAATTGGAGCACCACCATGGGTCCCTGCCACCCTTTGCTGTGGCCCAGGGC GCCCAGTTCCTGATCCGTCCTGTGGACAAAACCAATCAACAACCAACTTTAATCTGCA ACGTCACCAATGCCCTAGGAGCTCAGGAGCAGCAGAACTGACCGTCCAGGTCAAAG AGGGACCTCCCAGTGAGCACTTCAGGCATGTCCGTAACGCCATCATCTTCCTGG TTCTGGAATCCTGGGTTTTCTGAGCTGCTTTGGCACTGTCATCTGTCCCTGAGTA GTCCAAATGTTCCCTGAGTCTCTTGGCACTGCTCATCTGTCCCTGAGTA CAGAGCATGCCAGCCGCCTCAGCTAATGGGGCATGTCTCCTATTCAGCTGTGAGCA GAGAGAACAGCTCTTCCAGATCCACAGACAGGGCACAAGGTGACAGCGTC GGACTGAGAGGGGAGAGAGATGAAGACCCCTCCAAAGAGACCAGCCTCCTCCC TGTGCCAGACCCCAATGGATGAAGACGCGGGGCAGGTGCAAGTTCATAGGTCTCCAAGA CACCCTCCTTTCATTTGCTAGAAGGACTCACTAGACTCAGGAAGCTGTTAGGCT CACAGTTACAGTTTATTACAGTAAAAGGACAGAGATTAAGATCAGCAAGGGAG GAGGTGCACAGCACACGTTCCACGACAGATGAGGCGACGGCTTCCATCTGCCCT |

| SEQ ID NO: Name | Description | Sequence |
|---|---|---|
| | | CTCCCAGTGGAGCCATATAGGCAGCACCTGATTCTCACAGCAACATGTGACAAC
ATGCAAGAAGTACTGCCAATACTGCCAACCAGAGCAGCTCACTCGAGATCTTTG
TGTCCAGAGTTTTTGTTGTCTTGAGACAGGGCTGGCTCTGTTGGCAGACTA
GAGTCAGTGCAGATCACAGTTCATTGCAGCCTTGACTTCTCAACGCCAAGT
CATCCTCCACCTCAGCTCCTGAGTAGCTATGACTCAGGTATGTGCCACCACG
TCTGGCTAATCTTTTATTATTTGTAAAGTCGAGGTTCCCTGTGTTGCCCAGGC
TGGTCTTGAACTCTTGCCTCAAGTGATACTTCTGCCTTGCCTCCCAAAGTGCT
GAATTAAGCAGCTCACCATCCACACGGCTGACCTCATACATCAAGCCAATACCGT
GTGGCCCAAGACTCCAAGATCAGCTACCAGGACATATTCAAGGGCTTAGAGATG
AATGCCCAGGAGCTGAGGATAAAGGGCCCGATCTTTCTTTGGGCAAGGTTAAGC
CTTTACTGCATAGCAGACCACCACAGAAGGGTGTGGGCCACCAGAGAATTTTGGT
AAAAATTTGGCCTCTGCCTTGAGCTTCTAAATCTCGTCAGATCTCTG
TGGTTACAAGAACAGCCACTGACCCTGCTGCAATTCAGGCCG
CAAGCACTGCCTGGGGGTGTCCAAGGAGCAGAGAAAACTACTAGATGTGAAC
TTGAAGAAGGTTGTCAGCTGCAGCCACTTTCTGCCAGCATCTGCAGCCACTTTC
TGCCAGCATCTGCAGCCAGCAAGCTGGGACTGGCAGGAAATAACCACAAAGA
AGCAAATGCAATTTCCAACACAGGAAGGGATGCAGGGAGGCAGCGCT
GCAGTTGCTCAGGACACGCTCAGTGCAACTGACAAGTCTAAAAGGAAACTGTTGA
AGGAGCCCAGCTGCTCAGTGCAACTGACAAGTTAAAAGGAATGTATGATCTTGA
GGGCAGACAGCAGAATTCCTCTTATAAAGAAACTGTTTGGGAAAATACGTTGA
GGGGAAGAAGACCTTGGGCCAAGATGCTAAATGGGAATGCAAAGCTTGAGCTG
CTCTGCAAGAGAAATAAGCAGGACAGAGAGGATTGCTCTGAACAGAGATGGAAG
AGCCGGAACAGAGAAGTGTGGGAAGAGGCCAGTGGGACCCCACAGAGTTGGGGAGAT
AAAGGAACATTGGTTGCTTGGTGGCCAGTGAGGCTCCTTGTCTCTCCAGCAC
CCAGAATCTCATTAAAGCTTATTATTGTACCTCCAGCGCTGTGTGCAATGGG
GTCTTTTGTGGAAATCAAGGAGCAGACAGAGTTTCATGTGTACTGTCACCACGTG
GGATGGAACCAGAGGCATGGAAGCAAGACGCTAAATGAAGAGGGCATAAGGG
CTGGGATTCCCAGGCACCTTAGGAACAGCAGCTTGCTCTTTTTTTCCTCTCCAAA
AAAAATGTTTAAGGGACGGTGTCTCCTGTCACCCAGGCTGGAGTGCAATGGCAC
GATCATAGCTCATTGCAGCCTTCAACTCCGGGGCTCAAGCAATCCTCCCCACTCA
GCCTACCAAGTAGCTGAACCAGCTGCCCCTCACCAGTTAGAAGATAAAAGACATGAGGGAT
TAATTAGATAGTACATAAACCTCCAAAATTAGAAGACTAAAAGACATGAGGGAT
CCATTCTAATTGTGTTGGAGTGTAGCTGCAGCTCCATTCTTCTGCACATGG
ATATCCAGTTTTACACAACACTGTGAATGTAATGAATGCCACTGAATCATACACT
CAAAATAGCTAAAATGCAAATTGCTGTTATCTCTTTTAACCACCATTTTTG
AAAATTAATTATATACCAAAAAACCATTGAAATAGTGCACTTTATTTATTTATTT
GTTTATTTATTTATTTATTTAGAAATAAGAGTCTCACTTTGTTGCCCAGCCTGG
AGTGCAGTGCCGTGATCATGGCTCATTGCAGCCTCGACCTGCTGGCTCGGGCT
ATCCTTCCATCTCAGCCTCCCCGAGTAGCTGGGACTATAGGTGGCGCCACCCCA
CCTGCCTAAATCTCTTTTTAACTTTGTAGAGAGATAGGCATCTCGCTATGTTGCCT
AGGCTGGTCTGGAACTCCTCCAAGGCTCCTCCTCGCCTGGCCTCCCAAA
GCGCTAGGATTACAGATGTGAGCACCGCCCACCCGAACCTTACTTTTTTT
GCTCAGTTTCTGGTAATTCAGAGAATGCCTCCTGAGTTGTTCTACACCCACCTCA
TATTCCATGGAGGGCTGTACAGGGCTTTTTTAACGAGGCCTCTAAGGACAGGC
ATTTGTATCCTTCCAGCCTTTCACTATTACAATGTGTAGTAACTTTAA |

SEQUENCE LISTING

| SEQ ID NO: | Name | Description | Sequence |
|---|---|---|---|
| | | | CACTGTCATTTATTTTACTTTTTTTTTTTTTTATTTTAGAGAAAGAATCTTGCCA<br>TCTTGCCCAGGCTGGTCTCAAATTCCTGGGCCCAAACAATCCTCCCGCCCTTGGC<br>CTCCTAAAGTACTGGGATTATAGGCATAAGCCACCGTGCCTGCCCAATGCACA<br>CTGTCATTTAGCTCATGTTAACACCTGAGTTGTAGGACACACTCCTGGAGGTGGA<br>ATTGCTGGGCCAAAGGAGTATGTTTCTGTGTTGTCATTGTGATAGATATTGACAAATGA<br>ACCCTCAGAAGAGTTGTCGAGTTCTGTCTCCACCAGGCGACGTAGGCGATGAC<br>CTTTTTCTGAGGGAGGGGGCATCCTTGGAGTCCACAGAGCCAGGAATGAGA<br>GTGGGCCAGAATTTTGGTATAGGTGTTGTATAAACTTATAGTAAGGTTAAGAA<br>AACCGCAACTATCCTTATCAGAGACTTGGCCGGGGCGCAGGGTATGATGAGATC<br>ATAAGGAGGCTAAAACACTCCACACACTTCTGCATTGCTCCTGCACGGAG<br>TCGGGAATCTTTTCAGGTTGATACGATCTCACCTTGAGGAGCTGTGAGGTCCCA<br>GAAGCCTCTGGGTTGCAGATTGCTTGGGGTGAAAATGTCTGTCTACTGAAATC<br>TAACTTTTTACAAAAAATTACGGGCTGGGCGCAGTGGCTCACGCCTGTAATCCC<br>AGCACTTTGGGAGGCTGAGCGGGTGGATCACTTGAGGTAAGGAGTTCAAGAC<br>CAGACCATAGTGAAACCGTGTCTCTACAAAAAATTAGCCAGGTGTGGTGGTG<br>CATGCTTGTAATCCCAGCTACTCAGAAGGTGAGGTGGGAGAATCCCTTGAACC<br>CGGGAAGTGGAGGCTGGAGTGGAGCCATGATCGAGTTACTGCACTCCAGCCTGGG<br>TGACAAGAGTGAAGACTCTGTCTCCAAAAAAAAAAAAAAAAAACTGGAT<br>TGCCTGGCTCTACTCCGGGCACAGCATGCAGGCCCAGTTCTGCTCTGCTGT<br>TTGTTCTGCTTTTCCTCCACATATTGGCATCAGACCCAGAAGAAGCTGCCCATCCCTACCT<br>GCATTCCAGGCATCACCATCCAGACTCAGAACCGCATCCAGCAGAACCTCACCCA<br>GGGTGAGCCTTTTGTAGGAACGCATCCAGCAGAACCGCATCCAGCAGAACCTCACCCA<br>GCAGCGCTCTTTTCCGGTCTCATTCACCAGGCTGAAGGCTGACCAACAATCCCT<br>GGGCAAAGAATGGACCGCCTGGAAGGCTGCAGGACAGGATGGACTCCTAGACC<br>TCTGTTACCAGCAGTTGCTACCTCTGTCTGGGTGGTTGAACATGTTGAATTT<br>TATTCTAAGTACTGTCTACAAGTTCTGCAATAAACCTTGACTCTTCTTTTATAA<br>TGCAAA |
| 565 | Human CD155 | Human CD155 Variant alpha amino acid sequence<br>Uniprot accession number: P15151-1<br>Protein domains annotated as follows:<br>signal peptide (double line), extracellular domain (bold), transmembrane domain (italic) and cytoplasmatic domain (underlined) | MARAMAAWPELVALLVLSWPPPGTGDVVVQAPTQVPGFLGDSVTLPCYL<br>QVPNMEVTHVSQLTWARHGESGSMAVFHQTQGPSYSESKRLEFVAARL<br>GAELRNASLRMFGLRVEDEGNYTCLFVTFPQGSRSVDIWLRVLAKPQNT<br>AEVQKVQLTGEPVPMARCVSTGGRPPAQITWHSDLGGMPNTSQVPGFL<br>SGTVVTSLWLLVPSSQVDGKNVTCKVEHESFEKPQLLTVNLTVYPPEV<br>SISGYDNNWYLGQNEATLTCDARSNPEPTGYNWSTTMGPLPPFAVAQG<br>AQLLIRPVDKPINTTLICNVTNALGARQAELTVQVKEGPPSEHSGISRNAI<br>*IFLVLGILVFLILLGIGIYFYTWSKCSREVLWHCHLCPSSTBHASASANGHVSYSAVSR*<br>*ENSSSQDPQTEGTR* |

SEQUENCE LISTING

| SEQ ID NO: | Name | Description | Sequence |
|---|---|---|---|
| 566 | Human CD155 | Human CD155 Variant beta amino acid sequence NCBI accession number: NM_001135768.2 Uniprot accession number: P15151-2 Differs from P15151-1 (Seq ID NO: 565): 340-384: Missing. | MARAMAAAWPLLLVALLVLSWPPPGTGDVVVQAPTQVPGFLGDSVTLPCYLQVPN MEVTHVSQLTWARHGESGSMAVFHQTQGPSYSESKRLEFVAARLGAELRNASLRM FGLRVEDEGNYTCLFVTFPQGSRSVDIWLRVLAKPQNTAEVQKVQLTGEPVPMAR CVSTGRPPAQITWHSDLGGMPNTSQVPGFLSGTVTVTSLWILVPSSQVDGKNVT CKVEHESFEKPQLLTVNLTVYPPEVSISGYDNNWYLGQNEATLTCDARSNPEPTG YNWSTTMGPLPPFAVAQGAQLLIRPVDKPINTTLICNVTNALGARQAELTVQVKEG PPSEHSGTEHASANGHVSYSIAVSRENSSQDPQTEGTR |
| 567 | Human CD155 | Nucleotide sequence encoding human CD155 Variant beta NCBI accession number: NM_001135768.2 | AGCGGGACTGAGCGCCGGGAGAGAACCTGCGCAGGCCCAGGCGCGCGGGAGG GCCAGCCTGGGTGGCCCACCCGCCCTGGCCGCTGAAGAAGTGGGTATTCCCTTCCCACCCC AGGCACTGGAGGAGCGCCCCCGGGGATTCCAGGACTGCCTGAGCTCCGGAGCT GGACTCCAGCGACCCAGCTGCTCGGAGCGAGCGAGCGGGCGCGGAAGCGAGGAGACGC CCGCGGAGGCCCAGCTGCTCTGGAGACAACTGGCATGGCCCAGCCATGGCGCGC CCGTGCCGCTGCTGTCTGCGCCTGCCCTACTACTACCAGGTGCTCTCTGGCCGGCCACCCCAG GAACCGGGACGTCGTGTGACGCTGCCCTGCTACTACCAGGTGCCCGGCTTCTTGGGC GACTCCGTGACGCTGACTTGGGCGCCACCCTACTACAGGTGCCCAACATGGAGGTGACCGAT GTGTCACAGCTGACTTGGGCGCGCATGGTGAGTCCAAGCTGGCAGCATGCCGTCTTC CACCAAACGCAGGGGCCCAGCTATTCGGAGTCCAAACGGCTGGAATTCGTGGCA GCCAGACTGGGCGAGCTCGCGAATGCCTCGCTGAGGATGTTCGGGTTGCG CGTAGAGGATGAAGGCAACTACACCTGCCTGTTCGTCACCTTCCCCCAGGGCAG CAGGAGCGTGGATATCTGGCTCAGTGAGAGCCAGTGCCCATGGCCAAGCCCCAGAACACAGCTGA GGTTCAGGAAGGTCCAGCTCACCCTGCCCCCAGCCTCAGCACCTGGGCGCGGAT CACAGGGGTCGCCCCCAGCCCCAATACCCAAGCCAGACCTGCCCAGACCTGGGCGGAT GCCCAATACGAGCCAGGTGCCCAGGGTTCCTCTCGCACAGTCACTGTCACCAG CCTCTGGATATTGTGCCCTCAAGCCAGGTGGACGGCAAGAATGTGACCTGCAA GGTGGAGCACGAGAGC TTTGAGAAGCCTCAGCTGCTGACTGTGAACTCACCGTGCTGTACTACCCCAGAG GTATCCATCTGGCTATGATAACAACTGGTACCTTGGCCAGAATGAGGCCACC CTGACCTGCGATGCTCGCAGCAACCCAGAGCCCACAGGCTATAATTGGAGCACG ACCATGGGTCCCCTGCCACCCTTTGCTGTGCCCAGGGCCCAGCTCTGATC CGTCCTGTGGACAAACCAATCAACACAACTTTAATCTGCAACGTCACCAATGCCC TAGGAGCTGCCAGACGAGAACTGACCGTCCAGGTCAAAGAGGGACCTCCCAGTG AGCACTCAGGTACAGAGCATGCCAGCGCTTCCAGGATCCACAGACAGAGGGCACAA CAGCTGACAGAGGCGTCGGAGCTGAGAGGGAGAGAACTGGAGCTGGCAAGGACTG GGCTTCCAGCGTTGGACCCGACCCAATGGATGAGAAGATGAAGACCCCCCAAAGAGACC AGCCTCCCCTGTGCCAGACCTCCTTTCATTTGCTAGAAGGACTCACTAGACTCAGGAA GTCTCCAAGACCACCCTCTTTCAGTTTATTACAGTAAAGGACAGAGAGATTAAGAT AGCTGTTAGGCTCACAGTTACAGTTTATTACAGTAAAGGACAGAGAGATTAAGAT CAGCAAAGGAGGAGGTGCACGCACAGTTCCACGACAGATGAGGCGACGGC TTCCATCTGCCCTC TCCCAGTGAGCCATATAGGCAGCACCTGATTCTCCACAGCAACATGTGACAACA GTCAAGAAGTACTGCCAATACTGCCAACCAGAGCAGCTCACTCGAGATCTTTGT GTCCAGAGTTTTTGTCTTGTCTTGAGACAGGGTCTGCTCTGTTGGCAGACTAG |

| SEQ ID NO: Name | Description | Sequence |
|---|---|---|
| | | AGTACAGTGGTGAGATCACAGTTCATTGCAGCCTTGACTTCTCAACGCCAAGTC
ATCCTCCACCTCAGCCTCCTGAGTAGCTATGACTTACAGGTATGTGCCACCACGT
CTGGCTAATCTTTTATTATTTGTAAAGTCGAGGTTCCTGTGTTGCCCAGGCT
GGTCTTGAACTCTTGGCTCCAAGTGATACTTCTGCCTTGGCCTCCCAAAGTGCT
GAATTAAGCAGCTCACCATGCCACACGGCCTAAATCACATCATTCAAGCCAATACCGT
GTGGCCAAGACCCCCACCATAAATCACATCATTAGCATGAACATCAAGCCAGAGTG
GCCCAAGACTCCAAGATCAGCTACCAGGCAGGATATTCCAAGGGCTTAGAGATG
AATGCCAGGAGCTGAGGATAAAGGGCCCGATCTTTCTTTGGGCAAGGTTAAGC
CTTTACTGCATAGCAGACCACACAGAAGGGTGTGGGCCACCAGAGAATTTTGGT
AAAAATTGGCCTCTGCCCTTGAGCTCTACTTCTGTATCCGTCAGATCTCTG
TGGTTACAAGAAACAGCCACTTGACCCTGGTCACCAGAGGCTGCAATTCAGGCCG
CAAGCAGCTGCCTGGGGGGTGTCCAAGGAGCAGAGAAAACTACTAGATGTGAAC
TTGAAGAAGGTTGTCAGCTGCAGCCACTTCTGCCAGCATCTGCAGCCACTTTC
TGCCAGCATCTGCAGCCTGGGACTGGACTGGCATCTCAGGAAATAACCCACAAAGA
AGCAAATGCAATTTCCAACACAAGGGGAAGGATCAGGGGAGGCAGCGCT
GCAGTTGCTCAGGACACGCTCCTATAGGACCAAGATGGATGCGACCCAAGACCC
AGGAGGCCAGCTGCTCAGTGCAACTGACAAGTTAAAAGGTCTATGATCTTGA
GGGCAGCACAGCAGAATTCCTCTTATAAGAAACTGTTTGGGAAATACGTTGA
GGGAGAAGAACCTTGGGCCAAGATGCTAAATGGAATGCAAAGCTTGAGCTG
CTCTGCAAGAGACAGAAATAAGCAGGACAGAGAGATTAGGAACCAGCAGGATGGCAGG
AGCCGGGAACAGAAGAGTGTGGGGAAGAGATAGGACCCACAGAGTTGGGAGAT
GCAAAGGGCTCAAGGGTGAGGAGGCCAGTGGGACCCCACAGAGTTGGGAGAT
AAAGGAACATTGGTTGCTTGGTGGCACGTAAGCTCCTTGTCTGTCTCCAGCAC
CCAGAATCTCATTAAAGCTTATTTATTGTACCTCCAGCGCTGTGTGCAATGGG
GTCTTTTGTGGAAATCAAGGAGCAGACAGGTTTCATGTGTACTGTCACCACGTG
GGATGAACCAGAGGCATGGAAGCAAGA
CGCTAAATGAAGAGGGCCATAAGGGCTGGGATTCCCAGGCACCTTAGGAACAGC
TTGTCTTTTTTTTTTCCTCTCCAAAAAATGTTTAAGGACGGTGTCTCCTGT
CACCCAGGCTGGAGTGCAATGGCACGATCATAGCTCATTGCAGCCTCTAACTCC
GGGCTTCAAGCAATCCTCCCACCTCAGCCTACCAAGTAGCTGTGACCACAGCTG
CCCCTCACCATGCTAAGCTAATTTTTTAATTAGATAGTACATAAAGCTCCCAAA
ATTAGAAGATAAAAAGACATGGAGGGATCCATTCTAATTTGTTGTTTGGAGTGTAA
TGGTCCAGCTCCATTCTTCTGCACATGGATATCCAGTTTACACAACACTGTGAA
TGTAATGAATGCCACTGAATCATACACTCAAAAATAGCTAAAATGCAAATTGTC
TGTTATCTCTTTTTAACCACCATTTTGAATAATTATTATCCAAAAACCATTGA
ATAGTCACTTTATTTATTTATTTATTTGTTTATTTATTTATTTATTAGAAATA
AGAGTCTCACTTTGTTGCCAGGCTGGAGTGCAGTGGCGTGATCATGGCTCATT
GCAGCCTCGACCTCCTGGGCTCGGCTATCCTTCCATCCAGCCTCCCGAGTAG
CTGGACTATAGGTGGGCGCCACCACCCACCTGGCTAATCTCTTTTAACTTTTGT
AGAGATAGGCATCTCGCTATGTGCCTAGGCTGGAACTCCTGGGCTCAA
GTGCCTCCTCCGTCCCTTGGCCTCCCAAAGCGCTAGGATTACAGATGGAGCCACC
GCCCCACCCTGAACTTACTTTTTTGCCTCAGTTTCTGGTAATTCAGAGAATGC
CTCCTGAGTTGTTCTACCACCCACCTCATATCCATGGAGGCGTGACAGGGCT
TTTTAACGAGGCCTCAAGGACAGGCATTTGTATCCTTTCCAGCCTTTCACTAT
TACAATGTGTAGTGAATAACTTTACACACTGTCATTTATTTTACTTTTTTTTTTT
TTTATTTTAGAGAAGGAATCTTGCCATCTTGCCCAGGCTGGTCTCAAATTCCTG
GGCCCAAACAATCCTCCCGCCTTGGCCTCCTAAAGTACTGGGATTTATAGGCAT |

-continued

| SEQUENCE LISTING | | |
|---|---|---|
| SEQ ID NO: Name | Description | Sequence |
| | | AAGCCACCGTGCCTGGCCAATGCACACTGTCATTTAGCTCATGTTAACACCTGA<br>GTGTAGGACACACTCCTGGAGGTGGAATTGCTGGGCCAAAGAGTATGTTTCTTG<br>TCATTGTGATAGATATTGACAAATGAACCCTCACAGAAGTTGTGCTGAGTTCTGT<br>TCCCACCAGCGACGTAGGCGATGACCTTTTTCTGGAGGGAGGGGGCATCCTTGG<br>AGTCCACAGAGCCAGGAATGGAGAGTGGGCCCAGAATTTTGGTATAGGTGTTGT<br>ATAAACTTATAGTAAGGTTAAGAAAACCGCAACTATCCTATCAGAGACTTGGCG<br>GGGGGCAGGGTATGATGGAGATCATAAGGAGGCTAAAACACTCCACACCCTCCC<br>TCTGCATTGCTCCTGCACGGGAGTCGGGAATCTTTTCAGGTTGATACGATCTCA<br>CCTTGAGGAGCTGTGAGGTCCCAGAAGCCTCTGGGTTGCAGATTGCTTGGGGT<br>GAAAATGTCTGTGCTACTGAAATCTAACTTTTTACAAAAAATTACGGGCTGGGC<br>GCAGTGGCTCACGCCTGTAATCCCAGCACTTTGGGAGGCTGCAGCGGGTGGATC<br>ACTTGAGGTAAGGAGTTCAAGACCAGACCATAGTGAAACCGTGTCTCTACAAAA<br>AAAATTAGCCAGGTGTGGTGGTGCATGCTTGTAATCCCAGCTACTCAGAAGGCT<br>GAGGTGGGAGAATCCCTTGAACCCGGGAAGTGGAGGCTGGAGTAAACCATGAT<br>CGAGTTACTGCACTCCAGCCTGGGTGACAAGAGTGAGACTCTGTCTCCAAAAAA<br>AAAAAAAAAAAAAAAAAAACTGGATTGCCTGGCTCTACTCCGGGCACAGCATGC<br>AGGCCCAGTTCTGCTGCTCTGCTGTTTGTTCTGCTTTCCTCCACATATTGGCATC<br>ACCCTCTGGTGCCAAGATGGCTGCTGCATTCCAGGCATCACATCCAGACTCAGA<br>CCCAGAGAAGCTGCCCATCCCTACCTGGGTGAGCCTTTGTAGGAACGAGAAACC<br>GCATCCAGCAGCAGAAACCTCACCCAGCAGCGTCTTTTCCGGTCTCATTCACCAG<br>CGCCGCCCACCGCTCAACCAATCCCTGGCCAAAAGAATGGGACCGCCTGGAAGG<br>CTGGACCAAACAGGACCTGCCCTCTGGGGCTGGGGAGAGGCCCAGATGAAGGC<br>TGCAGGACAGGATGGACTCCTAGACCTCTGTTACCAGCAGTGACTACCTCTGTC<br>TGGGTGGTTGGAACATGTTTGAATTTTATTCTAAGTACTGTCTACAAGTTCTGCA<br>ATAAACCTTGACTCTTCTTTTAATAATGCAAA |
| 568 Human CD155 | Human CD155 Variant gamma<br>amino acid sequence<br>NCBI accession number:<br>NM_001135769.2<br>Uniprot accession number:<br>P15151-3<br>Differs from P15151-1 (Seq ID<br>No: 565):<br>331-331: E → G<br>332-384: Missing | MARAMAAAWPLLLVALLVLSWPPPGTGDVVVQAPTQVPGFLGDSVTLPCYLQVPN<br>MEVTHVSQLTWARHGESGSMAVFHQTQGPSYSESKRLEFVAARLGAELRNASLRM<br>FGLRVEDEGNYTCLFVTFPQGSRSVDIWLRVLAKPQNTAEVQKVQLTGEPVPMAR<br>CVSTGGRPPAQITWHSDLGGMPNTSQVPGFLSGTVTVTSLWILVPSSQVDGKNVT<br>CKVEHESFEKPQLLTVNLTVYYPPEVSISGYDNNWYLGQNEATLTCDARSNPEPTG<br>YNWSTTMGPLPPFAVAQGAQLLIRPVDKPINTTLICNVTNALGARQAELIVQVKGT<br>EHASASANGHVSYSAVSRENSSSQDPQTEGTR |
| 569 Human CD155 | Nucleotide sequence encoding<br>human CD155 Variant gamma<br>NCBI accession number:<br>NM_001135769. 2 | AGCGGGACTGAGCGCCGGGAGAGACCTGCGCAGGCGCAGGCGCGCGGGGAGG<br>GCCAGCCTGGGTGGCCCACCCCGCGCCTGGCGGGACTGGCCGCCAACTCCCCTC<br>CGCTCCAGTCACTTGTCTGGAGCTTGAAGAAGTGGGTATTCCCCTTCCCACCCC<br>AGGCACTGGAGGAGCGGCCCCCCGGGGATTCCAGGACCTGAGCTCCGGGAGCT<br>GGACTCGCAGCGACCGCGGCAGAGCGAGCGGGCGCCGGGAAGCGAGGAGACGC<br>CCGCGGGAGGCCCAGCTGCTCGGAGCAACTGGCATGGCCCGAGCCATGGCCGC<br>CGCGTGGCCGCTGCTGCTGGTGGCGCTACTGGTGCTGTCCTGGCCACCCCCAG<br>GAACCGGGGACGTCGTCGTGCAGGCGCCCACCCAGGTGCCCGGCTTCTTGGGC<br>GACTCCGTGACGCTGCCCTGCTACCTACAGGTGCCCAACATGGAGGTGACGCAT<br>GTGTCACAGCTGACTTGGGCGCGGCATGGTGAATCTGGCAGCATGGCCGTCTTC |

| SEQ ID NO: Name | Description | Sequence |
|---|---|---|
| | | CACCAAACGCAGGGCCCCAGTATTCGGAGTCCAAACGGCTGGAATTCGTGGCA |
| | | GCCAGACTGGGCGCGGAGCTGCGGAATGCCTCGCTGAGGATGTTCGGGTTGCG |
| | | CGTAGAGGATGAAGGCAACTACACCTGGCTCCGAGTGCTTGCCAAGCCCAGGCAG |
| | | CAGGAGCGTGGATATCTGGCTCCGAGTGCTTGCCAAGCCCAGAACACAGCTGA |
| | | GGTTCAGAAGGTCCACTGAGAGCCAGTGCCATGGCCCCGTGCCGTCTC |
| | | CACAGGGGTGCGCCCGCCAGCCCAAATCACCTGGCACTCAGACCTGGGCGGAT |
| | | GCCCAATACGAGCCAGGTGCCCAGGGTTCCTGTCTGGCACAGTCACTGTCACCAG |
| | | CCTCTGGATATTGGTGCCTCAAGCCAGGTGGACGGCAAGAATGTGACCTGCAA |
| | | GGTGGAGCACGAGAGC |
| | | TTTGAGAGACCTGCAGCTGCTGACTGTGAACCTCACCGTGTACTACCCCCAGAG |
| | | GTATCCATTCTGGCTATGATAACAACTGGTACCTTGGCCAGAATGAGGCCACC |
| | | CTGACCTGCGATGCTCGCAGCAACCCAGAGCCCACAGGCTATAATTGGAGACG |
| | | ACCATGGGTCCCCTGCCACCCTTGCTGTGGCCCAGGGCGCCAGCTCCTGATC |
| | | CGTCCTGTGGACAAACCAATCAACAACTTTAATCTGCAAGTGCTCACCAATGCCC |
| | | TAGGAGCTCGCCAGGCAGAACTGACCGTCCAGGTCAAGGTACAGAGCATGCCA |
| | | GCGCCTCAGTAATGGCATGTCTCCTATTCAGCTGTGAGCAGAGAGAACAGCT |
| | | CTTCCCAGGATCCACAGACAGAGGGCACAAGGTGACAGCGTCGGACTGAGAG |
| | | GGGAGAGAGACTGGAGCTGGCAAGGACGTGGGCCTCCAGAGTTGGACCCGACC |
| | | CCAATGGATGAAGAGCCCCCTCCAAAGAGACCAGCCTCCCTCCGTGCCAGACC |
| | | TCAAAACGACGGGGCAGGTGCAAGTTCACTAGACTTCAGGAAAGCTGTTAGGCTCACAGTTACA |
| | | CATTTGCTAGAAGGACTCACTAGACTTCAGGAAAGCTGTTAGGCTCACAGTTACA |
| | | GTTTATTACAGTAAAGGACAGATTAAGATCAGCAAAGGAGGAGGTGCACA |
| | | GCACACGTTCCACGACAGATGAGGCGACGGCTTCCATCTGCCCCTCCCAGTGG |
| | | AGCCATATAGGCAGCAGCTGATTCTCACAGCAACATGTGACAACATGCAAGAAG |
| | | TTTGTTTGTCTGAGACAGGGTCTGCTGTTGCCAGGTCCAGGTAGACTAGTGG |
| | | TGAGATCACAGTTCATTGCAGCCTTGACTTCTCAACGCCAAGTCATCCTCCACC |
| | | TCAGCCTCCTGAGTAGCTATGACTACAGGTATGCCACCACGTCTGGCTAATC |
| | | TTTTTATTATTTGTAAAGTCGAGGTTTCCCTGTGTTGCCCAAAGTGCTGAATTAAGCA |
| | | TCTTGGCTCCAAGTGACTATCTTCTGCCTTGGCCTGACTCATAGTGCTGGCCCAA |
| | | GCTCACCATCCACCAAGGCTGACCTCATACATCAAGGAGTGGCCCAAGACT |
| | | GACCCCCACCATAAATCACATCATTAGCATGAACCCAGAGTGGCCCAAGACT |
| | | CCAAGATCAGCTACCAGGCAGGATATTCCAAGGGTTAGAGATGAATGCCCAGG |
| | | AGCTGAGGATAAAGGCCCGATCTTTCTTTGGCAAGGTTAAGCCTTTACTGCA |
| | | TAGCAGCACACAGAAGGGTGGGCCACAGAGAATTTTGGTAAAAATTTGG |
| | | CCTCTGGCCTTGAGCTTCTAAATCTCTGTATCCGTCAGATCTCTGTGGTTACAAG |
| | | AAACAGCCACTGACCCTGGTCACCAGAGGGTGCAATTCAGGCCGCAAGCAGCTG |
| | | CAGGGGGTGTCCAAGCAGTCCAAGGAGCAGAAAACTACTAGATGTGAACTTGAAGAAG |
| | | GTTGTCAGCTGCCAAGCTGCAGCCACTTTCTGCCAGCATC |
| | | TGCAGCCAGCAAGCTGGGACTGGCAGGAAATAACCCACAAAAGAAGCAAATGCA |
| | | ATTTCCAACACCAAGGGGGAAGGGATGCAGGGGGAGGCAGCGCTGCAGTTGCTC |
| | | AGGACACGCTCCTATAGGACCAAGATGGATGCCAAGACCCAAGAGGCCCA |
| | | GCTGCCAGTCGACAAGCTGACAAGTTAAAAAGTCTATGATCTTGAGGCAGACAG |
| | | CAGAATTCCTCTTATAAAGAAACTGTTTGGGAAAATACGTTGAGGGAGAGAAG |
| | | ACCTTGGGCCAAGATGCTAAATGGAATGCAAAGTTGAGCTGCTCTCGCAAGAG |
| | | AAAATAAGCAGGAGGATTTGCTTGGACAGATGGAAGAGCCGGAACA |
| | | GAGAAGTGTGGGAAGAGATAGGAACCAGCAGGATGCAGGGGCAAAGGGCTC |

```
AAGGGTGAGGAGGCCAGTGGGACCCCACAGAGTTGGGAGATAAGGAACATT
GGTTGCTTTGGTGGCACGTAAGCTCCTTGTCTGTCTCCAGCACCCAGAATCTCA
TTAAAGCTTATTATTGTACCTCCAGCGGCTGTGTGCAATGGGGTCTTTTGTG
AAATCAAGGAGCAGACAGGTTTCATGTGTACTGTCACCACGTGGATGGAACCA
GAGGCATGGAAGCAAGACGCTAAATGAAGAGGGCCATAAGG
GCTGGGATTCCCAGGCACCTTAAGGACGTGTCTCTGTCACCCAGGCTGTCTTTTTTTTTCCTCTCCAA
AAAAAATGTTTAAGGACGTGTCTCTGTCACCCAGGCTGAGTGCAATGGCA
CGATCATAGCTCATTGCAGCCTCTACTCCGGGCTCAAGCAATCCTCCACCTC
AGCCTACCAAGTGTGACCACAGCTGCCCTCCACCATGCTAAGCTAATTTTT
TTAATTAGATAGTACATAAACGTCCAAAATTAGAGATAAAAGACATGAGGGA
TCCATTCTAATTTGTGTTGGAGTGTAATGTCCAGCTCCATTCTTCTGCACATG
GATATCCAGTTTTACACAACTGTGAATGTAATGAATGCACTGAATCATACAC
TCAAAAATAGCTAAAATGCAAATTGTCTGTTATCTTTTTTAACCACCATTTTT
GAAAAATTAATTATACCAAAAAAACCATTGAATAGTGCATTTTATTTATTTATTTATT
TGTTTATTTATTTATTTATTTTAGAAATAAGAGTCTCACTTTGTTGCCCAGGCTG
GAGTGCAGTGCGTGATCATGGCTCATTGCAGCCTCGAGCTCCTGGGCTCGG
CTATCCTTCCATCTCAGCCTCCCGAGTAGCTGGGACTATAGGTGGGCGCACCC
CACCTGGCTAAATCTCTTTTTAACTTTTGTAGAGATAGGCATCTCGCTATGTGC
CTAGGCTGGGCTGGAACTCCTGGGCTCAAGTGCTCCTCCTGATTGGCCTCCCA
AAGCCTAGGATTACAGATGTGAGCCACCGCGCCCACCCTGAGTTGTTCTACACCCACCTC
TGCTCAGTTTCTGGTAATTCAGGGCCTTTTTAACGAGGCCTCTAAGGACAGG
ATATTCCATCCCTTTCAGCCTTTCACTATTACAATGTTGTAGTGAATAACTTTAC
CATTTGTATCCTTTCAGCCTTTACTTTTTTTTTTTATTTTAGAGAAAGGAATCAAGCC
ACACTGTCATTTATTTACTTTTTTTTTTTATTTTAGAGAAAGGAATCAAGCC
ATCTTGCCCAGGCTGGTCTCAAATTCCTGGGCCCAAACAATCCTCCGCTTGG
CCTCCTAAAGTACTGGGATTTATAGGCATAAGCCACCGTGCCTGCCAATGCAC
ACTGTCATTTAGCTCATGTTAACACCTGAGTGTAGGACACACTCCTGGAGTGG
AATTGCTGGCCAAAGAGTATGTTTCTGTCATTGTGATAGATATTGACAAATG
AACCCTCACAGAAGTTGTGTGAGTTCTGTTCCCACCAGCGACGTAGGCGATGA
CCTTTTCTGGAGGGGCCATCCTTGGAGTCCAAGAGCCAAGAATGGAG
AGTGGGCCAGAATTTTGGTATAGGTGTTGTATAAACTTATAGTAAGGTTAAGA
AAACCGAACTATCCTTATCAGAGACTTGGCGGGGGCAGGGTATGATGGAGAT
CATAAGGAGGCTAAAACACTCCACACTTCCACCCTCCTCTGCATTGCTCCTGCACGGA
GTCGGGAATCTTTTCAGGTTGATACGATCTCACCTTGAGGAGTCTGTGAGGTCCC
AGAAGCCTCTGGGTTGCAGATTGCTTGGGGTGAAATGTCTGTGCTACTGAAAT
CTAACTTTTTACAAAAATTACGGGCTGGGCGCAGTGGCTCACGCCTGTAATCC
CAGCACTTTGGGAGGCTGCAGCGGTGGATCACTTGAGGTAAGGAGTTCAAGA
CCAGACCATAGTGAAACCGTGTCTACAAAAAAATTAGCCAGGTGTGGTGGT
GCATGCTGTAATCCCAGCTACTCAGAAGCTGAGGTGGGAGAATCCCTTGAAC
CCGGGAAGTGAGGCTGGAGTGAAAACATGATCGAGTTACTGCACTCCAGCCTGG
GTGACAAGAGTGAGACTCTGTCTCAAAAAAAAAAAAAAAAAAAAACTGAA
TTGCCTGGCTCTACTCCGGGCACACATGCAGCCCAGTTCTGCTCTGCTG
TTTGTTCTGCTTTCCTCCACATATTGGGCATCACCCTCGGTGCCAAGATGCTGC
TGCATTCCAGGCATCATCATCAGACTCAGACCCAGCTGCCCATCCTACC
TGGGTGAGCCTTTGTAGGAACGAGGATCACTTGAGGTAAGGAGTTCAAGA
AGCAGCGTCTTTTCCGGTCTCATTCACCAGCGCCCGCCACCGCTCAACCATCCC
TGGCCAAAAGAATGGGACCCGCTGGAAGGCTGGACCAAACAGGACCTGCCCTCT
```

SEQUENCE LISTING

| SEQ ID NO: | Name | Description | Sequence |
|---|---|---|---|
| | | | GGGGCTGGGGAGAGGCCCAGATGAAGGCTCGAGGACCAGGATGGACTCCTAGAC CTCTGTTACCAGCAGTGACTACCTCTGTCTGGGTGGTTGGAACATGTTTGAATT TTATTCTAAGTACTGTCTACAAGTTCTGCAATAAACCTTGACTTCTTTTAATA ATGCAAA |
| 570 | Human CD155 | Human CD155 Variant delta amino acid sequence NCBI accession number: NM_001135770.3 Uniprot accession number: P15151-4 Differs from P15151-1 (Seq ID No: 565): 385-392: TEHASASA → EHHQSCRN 393-417: Missing Differs from NM_001135770.3 340 M → I | MARAMAAWPLLLVALLVLSWPPPGTGDVVVQAPTQVPGFLGDSVTLPCYLQVPN MEVTHVSQLTVVARHGESGSMAVFHQTQGPSYSESKRLEFVAARLGAELRNASLRM FGLRVEDEGNYTCLFVTFPQGSRSVDIWLRVLAKPQNTAEVQKVQLTGEPVPMAR CVSTGRPPAQITWHSDLGMPNTSQVPGFLSGTVTVTSLMWILVPSSQVDGKNVT CKVEHESFEKPQLLTVNLIVYYPPEVSISGYDNNWYLGQNEATLTCDARSNPEPTG YNWSTTMGPLPPFAVAQGAQLLIRPVDKPINTTLICNVTNALGARQAELITVQVKEG PPSEHSGISRNAIIFLVLGILVFLILLGIGIYFWSKCSREVLWHCHLCPSSEHHQSC RN |
| 571 | Human CD155 | Nucleotide sequence encoding human CD155 Variant delta NCBI accession number: NM_001135770.3 | AGCGGGACTGAGCGCGGGAGAGAACCTGCGCAGGCGCGCAGGCGCGCGGGAGG GCCAGCCTGGGTGGCCCACCCCGCGCTGGCGGCAGCTGGCCGCCAACTCCCCTC CGCTCCAGTCACTTGCTCGAGCTTGAAGAAGTGGGTATTCCCCCTTCCCACCCC AGGCACTGGAGAGCGCGCCCCCGGGGATTCAGGACTTCAGGACTCCCGGGACT GGACTCGCAGCGACCCCAGCTGCTGGAGGAGCGGGCAACTGGCATGCCCAGCCAGGAGGACCGC CCGCGGAGGCCGCAGCTGCTCGGAGTGGAGCAACTGGCATGCCCAGCCATGGCCGC CGCGTGCCGCCTGCTCGTGTCGAGGCGCCACCAGCTGCGTGTCCTGGCCACCCCAG GAACCGGGACGTCGTGTCGCCCTGCTACTTACAGCAGTTGCCCAACATGGAGGTGACGCAT GACTCCGTGACGCTGCCCTGCTACTACAGGCAGGTGAGGTGAACATGGAGGTGACGCAT GTGTCACAGCTGACTTGGGCGCGGCATGGTGAAGTCCAAACGGCTGGAATTCGTGGCA CACCAAACGCAGGGGCCGCGGATGCCTCGCTGAGGATGTTCGGGTTGCG GCCAGACTGGGCGCGGAGCAACTCACACCTGCCTCTGTTCGTCACGTTCCCGCAGGGCAG CGTAGAGGATGAAGGCAACTCACACCTGCCTCTGTTCGTCACGTTCCCGCAGGGCAG CAGGAGCCGTGATATCTGGCTCGAGTGCTTGCCAAGCCCCAGACACAGCTGA GGTTCAGAAGGTCCAGCTCACTGGAGAGCCACCAGTGCCCATGCCCGCTGCGTCTC CACAGGGGTCGCCCGCCGCCCAAATCACCTGGCATCACCTCAGACCTGGGCGGAT GCCCAATACGACCCAGGTGCCCTCAAGCCAGGTGGACGGCACAGTCACTGTCACCAG CCTCTGGATATTGGTGCCCTCAAGCCAGGTGACGGCAAGAATGTGACCTGCAA GGTGGAGCACGAGAGC TTTGAGAAGCCTCAGCTGCTGACTGTGAACCTCACCGTGCTACCCCCAGAG GTATCCATCTCTGGCTATGATAACAACTGGTACTTGGCCAGAATGAGGCCACC CTGACCTGCGATGCTCGCAGCAACCCAGAGCCCACAGGCTATAATTGGAGCACG ACCATGGGTCCCCTGCCACCCTTTGCTGTGGCCCAGGGCGCCAGCTCCTGATC CGTCCTGTGACAACCAATCAACAACTTTAATCTGCAACGTCACCAATGCCC TAGGAGTCGCAGGCAGAACTGACCGTCCAGGTCAAGAGGGACCTCCCAGTG |

| SEQ ID NO: | Name | Description | Sequence |
|---|---|---|---|
| | | | AGCACTCAGGCATGTCCGTAACGCCATCATCTTCCTGGTTCTGGGAATCCTGG TTTTTCTGATCCTGCTGGGGATCGGGATTCTATTCTATTTGTCCAAATGTCCCG TGAGGTCCTTTGGCACTGTCATCTGTCCCTGCTGAGTGAGCATCACCAGAGCTG CCGTAATTGAGCACTTACTACGGGCTCTGTCTGCCATTCCAGTGTGCCTCT CACTGAATCCTCCACCCACTGCCATGAGGTTTCCCCATTTGACTGATGAGGGT GCAGAGCCAGGAGCCTTGTTGTTCACTGTTCATTGATTACATTTACAAATATATT TACAGAGTGGGA |
| 572 | Human CD155 | Human CD155 optimised nucleotide sequence for expression of extracellular domain | ATGGG -continued

SEQUENCE LISTING

| SEQ ID NO: Name | Description | Sequence |
|---|---|---|
| 574 Human CD155-Fc | Human CD155-Fc amino acid sequence NCBI accession number: AAH15542.1 Protein domains annotated as follows: Campath leader (double line), extracellular domain (Gly 27 to Asn 343 as per full length sequence) (bold), linker and Fc tag (italics) | MGWSCIILFLVATATGVHSGDVVVQAPTQVPGFLGDSVTLPCYLQVPNMEV THVSQLTWARHGESGSMAVFHQTQGPSYSESKRLEFVAARIGAELRNAS LRMFGLRVEDEGNYTCLFVTFPQGSRSVDIWLRVLAKPQNTAEVQKVQL TGEPVPMARCVSTGGRPPAQITWHSDLGGMPNTSQVPGFLSGTVIVTSL WILVPSSQVDGKNVTCKVEHESFEKPQLLTVNLTVYYPPEVSISGYDNN WYLGQNEATLTCDARSNPEPTGYNWSTTMGPLPPFAVAQGAQLLIRPV DKPINTTLICNVTNALGARQAELTVQVKEGPSEHSGMSRN*IEGREPKSCD* *KTHTCPPCPAPELLGGPSVFLFPPKPKDTLMISRTPEVTCVVVDVSHEDPEVKFNWY* *VDGVEVHNAKTKPREEQYNSTYRVVSVLTVLHQDWLNGKEYKCKVSNKALPAPIE* *KTISKAKGQPREPQVYTLPPSRDELTKNQVSLTCLVKGFYPSDIAVEWESNGQPEN* *NYKTTPPVLDSDGSFFLYSKLTVDKSRWQQGNVFSCSVMHEALHNHYTQKSLSLS PGK* |
| 575 Human CD155-His R&D 2530-CD | Human CD155-His amino acid sequence NCBI accession number: AAH15542 (His-tag not shown) Expressed protein Gly-Asn 343 as per full length sequence. | GDVVVQAPTQVPGFLGDSVTLPCYLQVPNMEVTHVSQLTWARHGESGSMAVFHQ TQGPSYSESKRLEFVAARIGAELRNASLRMFGLRVEDEGNYTCLFVTFPQGSRSVDI WLRVLAKPQNTAEVQKVQLTGEPVPMARCVSTGGRPPAQITWHSDLGGMPNTSQ VPGFLSGTVIVTSLWILVPSSQVDGKNVTCKVEHESFEKPQLLTVNLTVYYPPEVSI SGYDNNWYLGQNEATLTCDARSNPEPTGYNWSTTMGPLPPFAVAQGAQLLIRPV DKPINTTLICNVTNALGARQAELTVQVKEGPSEHSGMSRN |
| 576 Human CD112 | Human CD112 Variant delta amino acid sequence NCBI accession number: NM_001042724.1 Uniprot accession number: Q92692-1 Protein domains annotated as follows: Signal peptide (double line), extracellular domain (bold), transmembrane domain (italic) and cytoplasmatic domain (underlined) | MARAAALLPSRSPPTPLLWPLLLLLLLETGAQDVRVQVLPEVRGQLGGTVELPC HLLPPVPGLYISLVTWQRPDAPANHQNVAAFHPKMGPSFPSPKPGSERL SFVSAKQSTGQDTEAELQDATLALHGLTVEDEGNYTCEFATFPKGSVRG MTWIRVIAKPKNQAEAQKVTFSQDPTTVALCISKEGRPPARISWLSSLD WEAKETQVSGTLAGVTVISRFTLVPSGRADGVTVICKVEHESFEEPALI PVTLSVRYPPEVSISGYDDNWYLGRTDATLSCDVRSNPEPTGYDWSTTS GTFPTSAVAQGSQLVIHAVDSLFNTTFVCTVTNAVGMGRAEQVIFVRETP NTAGAGATGGIIGGIIAAIIATAVAATGILICRQQRKEQTLQGAEBEDEDLEGPPSY KPPTPKAK LEAQEMPSQLFTLGASEHSPLKTPYPDAGASCTEQEMPRYHELPTLEERSGPLHPG ATSLGPIPVPGPPAVEDVSLDLEDEEGEEEEYLDKINPIYDALSYSSPSDSYQGK GFVMSRAMYV |
| 577 Human CD112 | Nucleotide sequence encoding human CD112 Variant delta NCBI accession number: NM_001042724.1 | AGAATTCTTGGCAGGGGCGACCTTAGAATCCTGGGGAGGAGCGAGAATGAA TCCCGGGAGGAAGGAACAGGGGTGGAATCCGGGGGCGGGGGTCAGAACCCAGGA GGGGGCGGGGCCCGAGCCAGGCCAGGGTCGGCTTGACTCGGGGAGCAGCGGGTGA TCCTGTGACGTCAGCGGGTTCGAACCGCCGGAGCTGAGCGAGCAGAACAGGGGGT GCCGAGCCGGGAGAGCTGGGAGCGGAGAACAGAGAGGAGGCTAGA GCGCAGCGGGAACCGGCCCGGAGCCCGGGAGCCCCACGAGTGCCAGGCCCGGCCC AACCGCCCAGCCGATCGGCCCCCACAGAGTGCCCGGGCCGCTCCCTCCTGCCGCGC CCAGTCCCTCCCCGACGCCCCTCCTGCTGCCGCCGCTGCTGCTGCTCCTGCCGTCGAG ATGCCGCCGACGCGCCGCCGCCTGCTGTGGCCGCTGCTGCTGCTGCTCCTGGAAAC |

-continued

SEQUENCE LISTING

| SEQ ID NO: Name | Description | Sequence |
|---|---|---|
| | | CGGAGCCCAGGATGTGCGAGTTCAAGTGCTACCCGAGGTGCGAGGCCAGCTCG GGGGCACCGTGGAGCTGCCGTGCCACCTGCCTGCTGCTGTTCCTGGACTGTACA TCTCCCTGGTGACCTGGCAGCGCCCAGATGCCACCTGCGAACCACCAGAATGTGG CCGCCTTCCACCCTAAGATGGGTCCCAGCTTCCCCAGCCGCAAGCCTGGCAGCG AGCGGCTTCCTTGTCTCTGCCAAGCAGCACTGGGCACTGAGGACACAGAGGCAG AGTCCAGGAGACGCCACGCTGCCCTCCACCTTCCCAAGGGGTCCGTCCGAGGGATGACC AACTACACTTGCGAGTTTGCCACCTTCCCAAGAACCAAGCTGAGGCCCAGAAGGTCACG TGGCTCAGAGTCATAGCCAAGCCCAGAACCAAGCTGAGGCCCAGAAGAGGGCCGCCCA TTCAGCCAGGACCCTACGACGTGGCCCTTCTGCATCTCCAAAGAGGGCCGCCCA CCTGCCCGATCTCCTGGCTCTCATCCTGGACTGGGAAGCCAAAGAGACTCAG GTGTCAGGGACCCTGGCCGGAACTGTCACTGTCACCAGCCGCTTCACCTTGGTG CCCTCGGGCCGAGCAGATGGTGTCACGGTCACCTGCAAAGTGGACATGAGAG CTTCGAGGAACCAGCCCTGATACCTGTGACCCTCTGTACGCTACCCTCCTGAA GTGTCCATCTCCGGCTATGATGACAACTGGTACTCCGTGACTGATGCCACC CTGAGCTGTGACGTCCCAGCAACCCAGAGCCCACGGCTATGACTGGAGCACG ACCTCAGGCACCTTCCCGACCTCGTTCAATACCACCTTCGTCTGCACAGTCACCAATGCC CACGCAGTGGACAGTCTGTTCAATACCACCTTCGTCTGCACAGTCACCAATGCC GTGGGCATGGGCCGCTGAGCAGGTCATCTTTGTCCGAGAGACCCCAACACA GCAGGCCCAGGGGCCACAGGGCCATCATCGGGGCATCATCGCCGCCATCAT TGCTACTGCTGTGGCTGCCACGGCATCCTTATCTGCCAGCAGCGGAAGGA GCAGACGCTGCAGGGGCAGGAGGACGAAGACTTGGAGGGACCTCCCT ACAAGCCACCGACCCAAAAGCGAAGCTGGAGCACAGAGGAGATGCCCTCCCAGC TCTTCACTCTGGGGGCCTCGAGCAGGAGAATGCTCAAGACCCCACTCACTTTGATG CTGGCCCTCATGCACTGAGCAGGAGAATGCTCGATACCATGAGTGCCACCT TGGAAGAACGGTCAGGACCCTTGCACCTGGAGCCACAAGCTGGGGTCCCCA TCCCGTGCCTCCAGCCACCTGCTGTGAAGAGACCTTTCCCTGATCTAGAGG ATGAGGAGGGGGAGGAGAGAGTATCTGACAAGATCAACCCCATCTAT GATGCTCTGTCCTATAGCAGCCCTCTGATTCCTACCAGGCAAAGGCTTTGTC ATGTCCCGGGCCATGTATGTGAGCTGCAATGCGCCTGGCGTCTCACATCTCA CCTGTTGATCCTTAGCTTTCTTGCCAAGGATCTAGTGCCCCTGACCTCTGGCC AGGCCACTGTCAGTTAACACATATGCATTCCATTTGTGATGTCTACCTTGGTGGC TCCACTATGACCCCTAACCCATGAGCCAGGAGGTGGGAGGTGCTTCTGCACAACCT CTGGCAACCTTATCTCATGAGGCAGGAGGTGGACCTTAGAACATACCTCACCCC CCAATGCCTGACTCCCCCAAAATCACAAAGAAGACCCTAGACTTATAATTGTC TTCAGGTAGTAAATTCCAATAGGTCTGCTGAGTGGGCGCTGAGGGCTCCTG CTGCTCAGACCTGAGCCTTCCAGGCAGCAGGATTCCCAGCCAAGGCAGGGTTTCC CAGCACCTCCTGTAAGCAGAAGTTCAGGGTCCAGACCCTTCCCTGAGCCCC ACCCCCACCCCAATTCCTGCCTACCAAGCAAGCAGCCCCAGCCTTGGGAGGTCAGACA GGGTGAGCCTCATACAGACTGCCTTGATGGCCCCAGCCTTGCCCAGTGGAATAGGA TACTGTTAACCTGGAAGACTACTGAATCATTTTACCCTTGCCCAGTGGAATAGGA CCTAAACATCCCCTTCGGGAAGTGGGTCATGGTCGAATTGGGGTAGCAATT GATACTGTTTTGTAAACTACATTTCCTACAAAATGAATTTATACTTTGACCAG GAAAAAAAAAAA |

| SEQ ID NO: Name | Description | Sequence |
|---|---|---|
| 578 Human CD112 | Human CD112 Variant alpha amino acid sequence NCBI accession number: NM_002856.2 Uniprot accession number: Q92692-2 Differs from sequence Q92692-1 351-479: NTAGAGATGG...GATSLGSPIP → RASPRDVGPL...SLISRRAVYV 480-538: Missing | MARAALLPSRSPPTPLLWPLLLLLLETGAQDVRVQVLPEVRGQLGGTVELPCHLL PPVPGLYISLVTVQRPDAPANHQNVAAFHPKMGPSFPSPKPGSERLSFVSAKQSTG QDTEAELQDATLALHGLTVEDEGNYTCEFATFPKGSVRGMTWLRVIAKPKNQAEA QKVTFSQDPTTVALCISKEGRPPARISWLSSLDWEAKETQVSGTLAGTVTVTSRFT LVPSGRADGVTVTCKVEHESFEEPALIPVTLSVRYPPEVSISGYDDNWYLGRTDATL SCDVRSNPEPTGYDWTTSGTFPTSAVAQGSQLVIHAVDSLFNTTFVCTVNAVG MGRAEQVIFVRETPRASPRDVGPLVWGAVGGILLVLLLAGGSLAFILLRVRRRKS PGGAGGGASGDGGFYDPKAQVLGNGDPVFWTPVVPGPMEPDGKDEEEEEEEKA EKGLMLPPPPALEDDMESQLDGSLISRRAVYV |
| 579 Human CD112 | Nucleotide sequence encoding human CD112 Variant alpha NCBI accession number: NM_002856.2 | AGAATTCTTTGCAGGGGCGACCTTAGAATCTCGGGAGGAGCGAGAATGAA TCCCGGGGAGGAACAGGGGTGGAATCCGGGGGCGGGGTCAGAACGCCAGGA GGGGCGGGCCGGAGCCAGGGTCGGCTTGACTCGGGGGAGCGGGTGGA TCCTGTGACGTGCAGCGGGTTCGAACCGCCGGAGCTGAGCGAGGAGGCCGGAGCCGGAGGGT GCCGAGCCGGGCGGGAGAGCTGGGCCGGAGGAGAACAGGGAGGCTAGA GCGCAGCGGGAACCGGCCGGAGCCGGAGCGAGCCCAGGCACTACTA AACCGCCCAGCCGATCGGCCCGCTGTGTGGCCGGGCCTCCCTGCCCTCGAG CCAGTCCCCTCCCGCGCCCCTGCGTGTGGCCGCTCGGTGCCCTGCTGCCTCCTGGAAAC CGGAGCCCAGGATGTCGAGTTCAAGTGCTACCGGAGTGCGAGGCCAGTCTCG GGGGACACCGTGAGCTGGACCTGGCAGCGCCCAGATGCACCTGCGAACCACCAGAATGTGG TCTCCCTGGTGACCTGGCAGCGCCCAGATGGGTCCCAGCTTCCCAGCCGGAGCTGGCAGCG AGCGCTGCTGTCCTCTGCCAAGCACGAGACCACTGGGCAGTCAGCAAGAGCAG AGCTCAGGAGCGCACGCTGGCCTGCAGCCTCACGGTGAGGACGAGGGC AACTACACTTGCGAGTTTGCCACCTTCCCCAAGGGCTCCGTCCGAGGGATGACC TGGCTCAGAGTCATAGCCAAGCCCAAGAACCAAGCTGAGGCTCCAGAAGGTCACG TTCAGCCAGGACCCTACGACAGACCCACACCTGGTACTTCCAAAGAGGGCCCCA CCTGCCGGATTCCTGCTCTCATCCTGGACTGGGAAGCCAAAGAAGACTCAC CTGAGCTGTGACGTCCGCAGCAACCCAGAGCTGTGTCCCATGAAGCCTCACAAGCTTGAGCACG ACCTCAGGCACCCTCCCGACCTCGTTCAATACCTTGCTGTGAGCCTTCACAGTCATTCACAGTCACCAATGCC CACGCAGTGGACAGTCTGTTCAATACCTTCGTCTGCACAGTCACCAATGCC GTGGGGCATGGGGCCGAGCAGGTCATCTTTGTCCGAGAAACCCCAGGGC CTCGCCCCGAGATGTGGGCCTGTGTGGGGGCCGTGTGGGGGACACTGC TGGTGCTGCTGCTTCTGGCTGGAGGCAGGAGGCGAGCTGCCGAGGGTG AGGAGGAGGAAGAGCCCTGGAGGAGCAGGAGGAGGAGCCAGTGGCGACG GGGGATTCTACGATCCGAAAGCTCAGGTGTTGGGAAATGGGACCCGTCTTCT GGACACCAGTGCTCCCTGGTCCCATGGAACCAGATGCAAGGATGAGGAGGAG GAGGAGGAAGAAGGCAGAGAAAGGCCTCATGTTGCCTCCACCCCAGC AGTTTATGTGTGACCTGGACCAGAGACCAGAGCCAGGCCCCTCCCG |

SEQUENCE LISTING

| SEQ ID NO: | Name | Description | Sequence |
|---|---|---|---|
| | | | CCCCGACCTGACCACGCCGCCTAGGGTTCCAGACTGGTTGGACTTGTTCGTC TGGACGACACTGGAGTGGAACACTGCCTCCCGTCTCCCACTTTCTTGGGACTTGGAGGGAG GTGGAACAGACACTGGACTTCTCCCGTCTCTAGGGCTGCATGGGAGCCCGGG GAGCTGAGTAGTGGGGATCCAGAGAGGACCCCCGCCCCCCAGAGACTTGGTTTG GCTCCAGCCTTCCCCTGGCCCTGACACTCAGGAGTGACACTCAGAGTTAATAAATGCCTTGGAG GAAAACATCAAAAAAAAAAAAAAA |
| 580 | Human CD113 | Human CD113 amino acid sequence NCBI accession number: NM_015480.2 Uniprot accession number: Q9NQS3-1 Protein domains annotated as follows: Signal peptide (double line), extracellular domain (bold), transmembrane domain (italic) and cytoplasmatic domain (underlined) | MARTLRPSPLCPGGKAQLSSASLLGAGLLLQPPIPPPLLLLFPLLLFSRLCGALAG PIIVEPHVTAVWGKNVSLKCLIEVNETITQISWEKIHGKSSQTVAVHHPQ YGFSVQGEYQGRVLFKNYSLNDATITLHNIGFSDSGKYICKAVTFPLGNA QSSTIVTVLVEPTVSLIKGPDSLIDGGNETVAAICIAATGKPVAHIDWEG DLGEMRSTTTSFPNETATIISQYKLFPTRFARGRRITCVVKHPALEKDIRY SFILDIQYAPEVSVTGYDGNWFVGRKGVNLKCNADANPPFKSVWSRL DGQWPDGLLASDNTLHFVHPLTFNYSGVYICKVTNSLGQRSDQKVIYIS DPPTTTTLQPTIQWHPSTADIEDLATEPKKLPFPLSTLATIKDDTIATIIAS VVGGALFIVLVSVLAGFCYRRRRTFRGDYFAKNYIPPSDMQKESQIDVLQQDELDS YPDSVKKENKNPVNNLIRKDYLEEPEKTQWNNVENLNRFERPMDYYEDLKMGMKF VSDEHYDENEDDLVSHVDGSVISRREWYV |
| 581 | Human CD113 | Nucleotide sequence encoding human CD113 NCBI accession number: NM_015480.2 | ACGCGGGGCGGTGCCAGGGAGGGGAGTGCGGCGGCGGCGGCGCTCCC GCTTCAGCCTCGGCCAGTGGCGTCGGCGACGGCGGTGTCGAGGCAGCCAGC GTTCGGCGCCAAGTGTCAGCCGCCGACGACGGCGCTAGAGCTGGGAGCTGGGAC GGCGCGGCGCCGGACCTTCCACAGCCTCCGCCCAGAGCCTGAGGCGCGAGGCTG GGGGAGCCCGGGGCGGGGCGCCGGGCGCCCCGCTGTGTCCTGGAGGCGGCAAAGCACAACTT TCCTCCGCTTCTCTCCTGCTGCTTCGGAGCCCGGCTGCTGCTCTTCTCCAGGCTCTGTGGTGCC CCGCTCTGGACCAATTATTGTGGAGCCACATGTCACAGCAGTATGGGGAAGAAT TTAGCTGGACCAATTATTGTGGAGCCACATGTCACAGCAGTATGGGGAAGAAT GTTTCATTAAAGTGTTAATTGAAGTAAAACATAACACAGATTTCATGGG AGAAGATACATGGCAAAAGTTCACAGACTGTTGCAGTTCACCATCCCAATATG GATTCTCTGTTCAAGGAGAATATCAGGGAAGAGTCTTGTTTAAAATTACTCACT TAATGATGCAACAATTACTCTGCATAACATAGGATTCTCTGATTCTGAAAATAC ATCTGCAAAGCTGTTACATTCCCGCTCTGGAAATCCCAGTCCTCTACAACTGTAA CTGTGTTAGTTGAACCCACTGAGCCTGAGCCAGCCATTGCATGCAGCACTGAAAACCCG ATGGAGGAAATGAACAGTAGCAGTGGTTTGGTGAAAGAAGAAAAAGGTGTTAATCTCAAATGT CTTTCCAAATGAAACGGCGATTATCAGCAGTCCAGTACAAGCTATTTCCAACCAG ATTTGCTAGAGGAAGGCGAATTACTTGTGTTGTAAACATCCAGCCTTGGAAAA ACAGGATCCGATACTTTTCATATTAGACATACAGTATGCTCCTGAAGTTTCGGTA AATGCTGATGCAAATCCACCACCCTTTCAAATCTGTGTGACAGGTTGGATGAA CAATGGCCTGATGTTTATTCGTGTTATCCAGACATCTGCTCAGACAATACTCTTCATTTGTCCATCCAT TGACTTTCAATTATTCGTGTTTATATCTTTCAGATCCTCTAAGTGACCAATTCCCTTGGTCA AAGAAGTGACCAAAAAGTCATCCAACATTTCAGATCCCCTCCTACTACCCCTT CAGCCTACAATTCAGTGCATCCCTCAACTGCTGACATCGAGGAATCAGCAACA |

| SEQ ID NO: Name | Description | Sequence |
|---|---|---|
| | | GAACCTAAAAAATTGCCCTTCCCATTGTCAACTTTGGCAACAATTAAGGATGACA |
| | | CAATTGCCACGATCATTGCTAGTGTAGTGGGTGGGGCTCTCTTCATAGTACTTG |
| | | TAAGTGTTTTGGCTGGAATATTCTGCTATAGGAAGAACGACGTTTCGTGGAG |
| | | ACTACTTTGCCAAGAACTACATTCCACCATCAGATTGCTCAAAAAGAATCACAAAT |
| | | AGATGTTCTTCAACAAGATGAGCTTGATTCTTACCCAGACAGTGTAAAAAGAA |
| | | AACAAAAATCCAGTGAACAATGTAGAAAATCTCAATAGTTTGAAAGACCTGAAA |
| | | AAACTCAGTGGAACAATGTAGAAAATCTCAATAGTTTGAAAGACCAATGGATT |
| | | ATTATGAAGATCTAAAAATGGAATGAAGTTTGTCAGTGATGAACATTATGATG |
| | | AAAACGAAGATGACTTAGTTTCACATGTAGATGTTCCGTAATTTCCAGGAGGG |
| | | AGTGGTATGTTTAGCAACCACTGAATGTGACTAACATGTAACATGTTCATTCA |
| | | CACTAGTTGATCATTTTCAGATTGTTCATACTTTTCTGAGGAAGAATAAGCTT |
| | | TTTCAAGTTGATTTTCAAGCTTACTTTTTATATTCTAATCTGACAAATGAAAATG |
| | | TAAAATCTGAGTTCAGTGATTCTAAGCTGCTTTACAATTTTTTTCAATGCTGTA |
| | | CTACTGTCTCAAGATTTAAATTTAATGCAGATACTATTTATTGGTGTGAGCACA |
| | | CAGGTAAGAAGAAATGTCAACATTAAAATGATGACTTACTTGGTACAAAAATTTT |
| | | TAAAAAGGGAACTACCTTGACATTGTGTATTAAATGTTACCTAAGACTATAAT |
| | | CTCAAGTATGATGTTTGTTTAACATATACCTCTCAAAATTTATCACCACTCAATG |
| | | ACACTGCATCAAAATTGACTATAAAACTTCAAGAAATATTTATATATATTTTT |
| | | TAATATACAAAAAATATTAGCCTGATGGAATGCTTTCCTTTTTTCAAACATTATT |
| | | TTCTAAGTTCTATACAAATGAAATCTTACCTCTGCATATTAATGAGCCTTGCC |
| | | ATAATTACTGTAGAGTTGGCTTTTCAAAGATATTTTTGTTGCACTAAAACTGTGGTA |
| | | GTAAACTCAGTGAACATGATGCTGTGAAGAGCATATATTAGCTGTCAATATTTT |
| | | TGTCCAAAATACCTGCAAGAGTAATAAAATACATACCTTTCAAACATGATAATTA |
| | | TTATTTTTTTTTCCTTTCTGGAACATGATTTTGGTACATTAGCAGTAGCCT |
| | | TATTTTAATGCTTTATGTCCTAAACATACTAATAGAAATGAAAGACGCAGAGAG |
| | | AGCATTTCGAATACTAGTTTTGAAGTACTAGTTTTAGAAATGAGACTTTCAGCCAACAAT |
| | | CTATAGAAAGAATTTTATGGACCATCTTGTTGTTTAGTTATTATTGTTGATGTGT |
| | | TCAAATGGGTAAATGTACAGAAAAGAAAATTTTAGAGTAAACTTGGAACTTTGA |
| | | TATAACTAGAAAAACTAGATTATAGAATTAGTCGGTAACACTTGCTAATGGACA |
| | | TTGGCATTCATCTCCCTCCTTTTCCTCCAGTGATGTATGTGTTTAAGATTTCTG |
| | | TTTTTACGATTAAAACTGGAAACATGAGGTTTTGTTTTTGTTTTTTACATAA |
| | | TTACATATATTCCTTCTGAATCATTTATTCTTTGAGAAAGAAATGTTACCTAAAC |
| | | TTCAAATGTGCTTTTGTTTGTGTGAGGTAATTAAAATGCTTCTACAGTGGAGGCTT |
| | | ACAAATTATTGTGACAACTATTTTGCCAGTGAAATGAAGTGGAAGTTAGTAGG |
| | | AGTCATTGAAAAGTGACCATTTTGCCAGTGAAATGAAGTGGAAGTTAGTAGG |
| | | AGAATCATTAAAATTAAATATATTTGTTAATAAAAGGCAAAGTAGTAGGTAC |
| | | TTTTTAAACCCTCCCAACCAGCCTTTCTCAATATTCATCAAATCTAAAACATTTA |
| | | GGGGGCAAAATTCTAACATGTTCATGGTATCTTGCAAATAGTGAAAGCTTTATTC |
| | | TGAAGGATATAAACTAGTTTTCTTCATTTTAACTAGCACATTTGTGAAATT |
| | | AGAAACCTCTTTTATTTCTTCCCAAAGTAATACTTATTATAAGGCTGTAGTA |
| | | TCGGTTAAGGATACAGATAATAATAAAGTTCACTTATATCTTCTTACAAATGTCTG |
| | | GGTTTTAATATGGTTAATCACTTATATCACAAATATTACAACTTTTTAGTGCAAGT |
| | | TTTTGGAAGAAACTTTTTGATAAAACACTGTGATTGACTTATTTTTAA |
| | | TTTAAACGATGAGGTGGCCAGAAGAAATGGGTCAAAATTCTCCCCATGAA |
| | | AGATGTAAAACTATGCTTTTTTAAAATCAAAATTCATCTTTAGGATTCTATATAA |
| | | TTTGAAATACTGTATGGATCTGAACAGGAATAATCACATTTTAGGATTCTATATAA |
| | | TCTCAACTGGAGTATAATCTGAAGGAATTAGCAGTGTATTTAAGAAATATATT |

| SEQ ID NO: Name | Description | Sequence |
|---|---|---|
| | | TCAAAATATAATCTGATTATGAACTTCCTTTTACATTGTGGTTATTGTGCG<br>ATTAGGTTTTTTGTTGTTTCTTTGTGTTGTTTGGCGGGAGAGGGTGACCT<br>GGAAAGCCACAAGTGAGTATTTGACATATTCTGTATCCTAATCAATCATTGG<br>CAAACTTAAAAGTTTCTGTGTTTATTAGAACATCTGATACTAGTGCTTAAGACTTTGG<br>GAAGCATTGCACTGTTGTTTTGAACATCATTTGAATTTACTGACATAGAGA<br>CTTGTTTGAAAACATGATATAGTCATTAAATAAAGACATTGTTAAATTAGTTTTG<br>AATACCAGTGATATTCATAACTACTTGACAGGTATATATATGAAAATTCTACTATCG<br>TGAAAAAATGAATATTTGTACTATTTTGGCCATATTATTTATATTTATTCTTTCA<br>TATGGTTTGAACTGTTTTAGCATTTGTAAATTCACTTGAGAGTTTTCTTTCTG<br>CTGGTTAAATATTCAATGATATAATGAAGATGAATGCAACTCTTATTTTCTG<br>CCATTTTTTATTAAAATACATTGAAACTAAAGTAGGCTCGGGGTTAACTTTAAAA<br>GTGATATTTGAGAAGTGCTTTAGAGTTGAAAGATTTAGTATTTTACCACGTGCC<br>TAGTAGGGTTCTATTTGCTAACTCTAATATTGAGGAAACTATTAAGGTTTTCAGT<br>AGTAAGTGTGTCTTCTAATACGCCATATACAGGAAAGTTTATAAGATAACCACG<br>GCTAAATATTTTGCATTAAGGAGCTGTAGGAGTACAGTGTATAAGTACAGAAAT<br>TGAGAGAAATGTAGTCATTTTATATGTGAACAAGTAAGAACATCTGATTTGAGTTTTGATAA<br>ATACTGCTAAAACCAGTATATGAACAAGTAAGAAGTTTATGTATGAAAGTAATC<br>AATGTAAAATATAAGGAATAAATGTACCCCATTTTGAATTTTAATTCTAA<br>TAGGAGAGTAGATTGTAGAATTGCTCTTTCCTGTTTACTTGTATATTAGAAA<br>ATGCATCCTCATAAACAGCTCCTTTCTCAAATTTTTGGTTTTGTGTTTGTGT<br>TTTGGTTTTAGTTTGTACCCGCTAAGTTTTGGTTTTGTGTTTTGGTGTTT<br>TTTGTTTTTGTTTTTTTGTTTTTCTTTTTTTAACCAACCTGTGTATTAG<br>GTCTTAGCCCCAATAGCCATGCATGAAATCTTTAAATAAGTTAAAAAGTTCT<br>TTAGAGGCAAAAAAAAAAA |
| 582 Human CD113 | Human CD113 amino acid sequence (alternative isoform)<br>NCBI accession number: NM_001243286.1<br>Uniprot accession number: Q9NQS3-2<br>Differs from sequence Uniprot Q9NQS3-1 (Seq ID No: 580)<br>357-366: DPPTTTTLQP → AYNSVASLNC<br>367-549: Missing | MARTLRPSPLCPGGKAQLSSASLLGAGLLLQPPIPPPLLLFPLLLFSRLCGALAG<br>PIIVEPHVTAVWGKNVSLKCLIEVNETITQISWEKIHGKSSQTVAVHHPQYGFSVQ<br>GEYQGRVLFKNYSLNDATTLHNIGFSDSGKYICKAVTFPLGNAQSSTTVTLVEPT<br>VSLIKGPDSLIDGGNETVAAICIAATGKPVAHIDWEGDLGEMESTTTSFPNETATIIS<br>QYKLFPTRFARGRRITCVVKHPALEKDIRYSFILDIQYAPEVSVTGYDGNWFVGRKG<br>VNLKCNADANPPPFKSVWSRLDGQWPDGLLASDNTLHFVHPLTFNYSGVYICKVT<br>NSLGQRSDQKVIYISAYNSVASLNC |
| 583 Human CD113 | Nucleotide sequence encoding human CD113<br>NCBI accession number: NM_001243286.1 | ACGCGGCGGGTGCCCAGGGAGGGAGGGAGTGGCGCGCGGCGGCGGCTCCC<br>GCTTTCAGCCTCGGCAGTGGCTCGGCGACGGCGGTGTCGAGGCAGCCGCCAGC<br>GTTCGGCCAAGTGTCAGCCGGCGACGGCGCTAGAGCTCGGGAGCTGGGGAC<br>GCGCGCCGCCAAGCCTTCCACAGCCTCCGCCCAGAGCCGGGGGAGGTGGGGATG<br>GCGGAGCACCCGTCGGCCGTCCCCGCTGTGTCCTGGAGGCGCAAAGCACAACTT<br>TCCTCCGCTTCTCTGCTGCTTCTCCGAGCCCGGGCTCGTCGCAGCCCCGACGCCACCT<br>CCGCTGCTGCTGCTCTTTCCGCGTGTGCTGCTCCAGGCCTCGTGGTGCC<br>TTAGCTGACCAATTATTGTGGAGCCACATGTAAGCAGTAGTGGGAAAGAAT<br>GTTTCATTAAGAGTGTTAATTGAAGTAAATGAAACCATAACACAGATTTCATGG |

| SEQ ID NO: Name | Description | Sequence |
|---|---|---|
| | | AGAAGATACATGGCAAAAGTTCACAGACTGTTGCAGTTCACCATCCCAATATG
GATTCTCTGTTCAAGGAGAATATCGCAGGAAGAGTCTTGTTTAAAAATTACTCACT
TAATGATGCAACAATTACTCTGCATAACATAGGATTCTCTGATTCTGAAAATAC
ATCTGCAAAGCTGTTACATTCCGCTTGGAAATGCCCAGTCCTTACAAACTGTAA
CTGTGTTAGTTGAACCCACTGTGAGCCTGATAAAAGGGCCAGATTCTTTAATTG
ATGGAGAAATGAAACAGTAGCAGCCATTTGCATCGCAGCCACTGAAAACCCG
TTGCACATAATTGACTGGGAAGGTGATCTTGGTGAAATGGAATCCACTACAACTT
CTTTTCCAAATGAACGGCAACGATTATCAGCCAGTACAAGCTATTTCCAACCAG
ATTTGCTAGAGGAAGGCGAATTACTTGTGTTGTAAAACATCCAGCCTTGGAAAA
GGACATCCGATACTCTTTCATATTAGCACATGATGCTCTGAAGTTTCGGTA
ACAGGATATGATGGAAATTGGTTTGTAGGAAGAAAAGGTGTTAATCTCAAATGT
AATGCTGATGCAAATCCACACCCTTCAAATCTGTGTGGAGCAGGTTGGATGGA
CAATGGCCTGATGGTTTATTGGCTTCAGACAATACTCTTCATTTTGTCCATCCAT
TGACTTTCAATTATTCTGGTGTTTATATCTGTAAAGTGACCAATTCCCTTGGTCA
AAGAAGTGACCAAAAGTCATCTACATTTCAGCCTACAATTCAGTGGCATCCCTC
AACTGCTGACATCGAGGATCTAGCAACAGAACCTAAAAAATTGCCCTTCCATTG
TCAACTTTGGCAACAATTAAGGATGACACAATTGGCCACGATCATTGCTAGTGTAG
TGGGTGGGGCTCTCTTCATAGTACTTGTAAGTGTTTTGGCTGGAATATTCTGCT
ATAGGAGAAGACGGACGTTTCGTGGAGACTACTTTCGCCAAGAACTACATTCCAC
CATCAGATATGCAAAAGAATCACAAATAGATGTTCTTCAACAGATGAGCTTGA
TTCTTACCCAGACAGTGTAAAAAAACAAAATCCAGTGAACAATCTAATA
CGTAAAGACTATTTAGAAGAGCCTGAAAAACTCAGTGGAACAATGTAGAAAAT
CTCAATAGGTTTGAAAGACCAATGGATTATTATGAAGATCTAAAAATGGGAATG
AAGTTTGTCAGTGATGAACATTATGAACATTATGAAAAC
GAAGATGACTTAGTTTCACATGTAGATGGTTCCGTAATTTCCAGGAGGGAGTGG
TATGTTTAGCACCACTGAATGTGACTTAACTATGTGACAATGTTCATTCACACTA
GTTGATCATTTTCAGATTGTTCATACTTTTTCTGAGGAAGAATAAGCTTTTCA
AGTTGATTTTCAAGCTTACTTTTTATATTCTAATCTGACAAATGAAAATGTAAAA
TCTGAGTTCAGTGTATCTAAGCTGCTTTACAATTTTTTCAATGCTGTACTACT
GTCTCAAGATTTAAATTTAATGCAGAGTACTTACTTGGTACAAAAATTTTTAA
TAAGAGAAAATGTCAACATTAAATGTATGACTTAAATGTTTACCTAAGACTATAATCTCA
AAAGGAACTACCTTGACATTGTGTATTAAATATACCTCCAAAATTTATCACCACTCAATGACAC
AGTATGATGTTTGTTTAACATATAAAACTAATTCAAGAAAATTTTATATATATTTTTAAT
TGCATCAAAAATTGACTATAGAACTAATTCAAGAAAATATTTTATATATTTTTTTAAT
ATACAAAAATATTAGCCTGATGGAATGGCTTTTCCTTTTCAAACAATATTTCTCT
AAGTTTCTATACAAATGAAATCTTTACCTCTGCATATTAATGAGCCTTGCCATAA
TACTGTAGAGTGGCTTTCAAGATATTTGTTGCACTAAAACTGTGGTAGTAA
ACTCAGTGAACATGATGTGTGGAAGACATAATTAGCTGGTCAATATTTTGTC
CAAAATACCTGCAAGAGTAATAAAATACATTTCCAAACATGAATAATATTAG
TTTTTTTTTTTCCTTTCTGAACATGGATTTTGGTACATTAGCAGTAGCCTTATT
TTAATGCTTTATGTCCTAAACATACTAGTTTTTAGAAATGAAAATGAAAGACGCAGAGAGCA
TTTCGGAATACTAGTTTTGTTTTATTAATTGAGACTTTCAGCCAACAATCTAT
AGAAAGAATTTTATGACCATCTGTTTGTTAGTTATTTAATGTTGATGTTGTTCAA
ATGGGTAAATGTACAGAAAGAAATTTAGAGTAAACTTGAACTTTGGATATA |

| SEQ ID NO: Name | Description | Sequence |
|---|---|---|
| | | ACTAGAAAAACTAGATTATAGAATTAGTCGTAACACTTGCTAATGGACATTGG
CATTCATCCACTTTTTCCTCCTAAGTGTATGTATGTGTTTGTTTTTAAGATTTCTGTTT
TACGATTAAAACTGAAACATGAGTGTTTTTGTTTTTGTTTTTACATAATTAC
ATATATTCCTTCTGAATCATTTATCTTTGAGAAAGAAGTTACCTAACTTCA
AATGTGCTTTTTGTGAGGTAATTAAATTGCTCTACAGTGGAGGCTTACAA
AATTATTGTGACAACTATTTTGAAGCTGAAGGATAGTTTTCTATTGCTAGTC
ATTTGAAAAGTGACCATTTTGCCAGTGAATGAAATGAAGTGAAGTAGAGAA
TCATAAATTAAATATATATTTGTTAATAAAAGGCAAAGTAGTAGTACTTTT
TAAACCCTCCCAACCAGCCCTTTCTCAATATTCATCAAATCTAAAACATTAGGG
GGCAAATTCTAACATGTTCATGGTATCTTGCAAATAGTGAAAGCTTATTCTGA
AGGATTATAAACTAGTTTTCTTCATTTTAACTAGCACTATTTGTGAAATTAGA
AACCTCTTTATTTCTCTCCCAAAGTAATACTTATTATAAGGCTGTAGTATCA
GGTTAAGGATACAGATAAAATAAAGTTCACTTATATCTTCTTACAAATGTCTGGGT
TTTAATAGGTTAATCACTTATATACAAATATTACAACTTTTTAGTGCAAGTTTTT
GGAAGAAAACTTTTTGATAAAACACTGTGATTGATGTGACTTATTTTAATTTA
AACGATGAGGTGCCAGAAGAAAGATGGGTCTAAAATTCTCCCCATGAAAGAT
GTAAAACTATGCTTTTTTTAAAATCAAAATTTCATCTTTAAAATAATGGTTTG
AAATACTGTATGGATCTGAACAGAAATAATCACATTTAGGATTCTATATAAATCTC
AACTGGAGTATAATCTGAAGGAAATTAGCAGTGTATTTTAAGAATATATTTCAA
AAATATAAATACTGATTATGAACTTCCTTTTGTTGTGGTTATTTGTGCGATTA
GGTTTTTGTTTGTCTTTTGTTCTTTTGTTTGGCGGGAGAGGGTGACCTGAA
AGCCACAAGTGAGTATTTGACATATTCTGTATCCTTAATCCAATCATTGGCAAA
CTAAAAGGTTCGTGTGTTATTAGAAATCTGATACTAGTGCTTAAGACTTTGGGAA
GCATTGCCACTGCTGTTGTTATTAGAAACTTTATGTATATTACTGTACATAGAGACTT
GTTTGAAACATGAACATAGTCATTAAATAGACATTGTTAAATTAGTTTTTGAAT
ACCAGTGATATTCATACTACTTGACAGGTATATATGAAAATTCTACTATCGTGA
AAAAAATGAACTGTTTTAGCATTTTGTAACTATTTTGGCCATATTCACTTGAGAGTTTCTTTCATAT
GGTTTGAACTGTTTTGTAAATTCACTTGTAAATTCACTTGAGAGTTTCTTTCACTG
GTTAAAATATTTCAATGATATAATGAAGATGAAGATGGAATGCAACTCTTATTTTTCTGCCA
TTTTTATTAAAATACATTGAAACTAAAGTAGGCTCGGGGTTAACTTAAAAGTG
ATATTTGAGAAGTGCTTAGAGTTGAAAGATTTAGTATTTTACCACGTGCCTAGT
AGGGTTCTATTTGCTACTCTAATAGCCATATACAGGAAGTTTTATAAGATAACCACGGCTA
AGTGTTGCTTCTAAGACCATATACAGGAGAGTACAGTGTATAAGTAACAGAAATTGAG
AATATTTGCATTAAGGAGTGTAGGAGTACAGTGTATAAGTAACAGAAATTGAG
AGAAAATGTAGTCATTTTATATGTGAAAACATCGATTTGAGTTTTTGATAAATAC
TGCTAAAACACAGTATATGAACAAGTAAGAAGTTTATGTATGAAAGTAATCAATG
TAAAATATAAGAAAGGAATAAATGTACCCATTTTGAATTTTAATTCTAATAGG
AGAGTAGATTGTAGATTGAATTGCTTTCCTGTTTALTTGTTAATTAGAAAATGC
ATCCTTCATAAACAGCTCCTTTCTCAAATTTTTGTATATTGTGTTGTGTTGG
GTTTTAGTTTGTTGTACCCGCTAAGTTTGTTTTTCTTTTTAACCAACCTGTATTAGGTGTT
TTGTTTTGTTTGTTTGTTGTTTTCTTTTATTAACCAACCTGTATTAGGTGTT
AGCCCCAATAGCCATGCATGAAATCTTTAAATAAAGTTAAAAAAAGTTCTTTAGA
GGCAAAAAAAAAAA |

SEQUENCE LISTING

| SEQ ID NO: | Name | Description | Sequence |
|---|---|---|---|
| 584 | Human CD113 | Human CD113 amino acid sequence NCBI accession number: NM_001243288.1 Uniprot accession number: Q9NQS3-3 Differs from sequence Uniprot Q9NQS3-1 (Seq ID No: 580) 1-54: MARTLRPSPL...PLLLFSRLCG → MAEGWRWCFVRTPGLLRGPLLP RSFSGNPR 357-549: DPPTTTLQP...SVISRREVVYV → DVPFKQTSSI...VYIDPREHYV | MAEGWRWCFVRTPGLLRGPLLPRSFSGNPRALAGPIIVEPHVTAVWGKNVSLKCL IEVNETITQISWEKIHGKSSQTVAVHHPQYGFSVQGEYQGRVLFKNYSLNDATITL HNIGFSDSGKYICKAVTFPLGNAQSSTIVTVLVEPTVSLIKGPDSLIDGNETVAAIC IAATGKPVAHIDWEGDLGEMSTTTSFPNETATIISQYKLFPTRFARGRRITCVVKH PALEKDIRYSFILDIQYAPEVSVTGVDNMFVGRKGVNLKCNADANPPPFKSVWSR LDGQWPDGLLASDNTLHFVHPLTFNYSGVYICKVINSLGQRSDQKVIYISDVPFKQ TSSIAVAGAVIGAVLALFIIAIFVTVLLTPRKKRPSYLDKVIDLPPTHKPPPLYEERSPP LPQKDLFQPEHLPLQTQFKEREVGNLQHSNGLNSRSFDYEDENPVGEDGIQQMYP LYNQMCYQDRSPGKHQNNDPKRVYIDPREHYV |
| 585 | Human CD113 | Nucleotide sequence encoding human CD113 NCBI accession number: NM_001243288.1 | AGGTCTGTGGTAGGTGAACCTCGGCGGCCCGGCTGGGCTGAGGGAGCCGCCA CTGAGGGTGCGGGCGCCGCCGGCTCTGCCAGCCGTTCTCTGGAGCAGCGA GGCGGTTGGTTGTGCCAGCGAGTGCCGAGGACTTTGCTGCTGAAACTTTCGC GCGCCCGGGCGAGGCCTGAAGGGCCGCGGCGCAATGCTGAGCCGCGGCGG CCCGTCTGCCCTCGCCCCCGGCGTCGCGGGTTGCCGCGCCGTGCGAGGGTT GGCGATGGTGCTTGTCGCCGAACTCGTGGTTGCTCGGGGACCGTTACTTC CTCGCTCATTCTCAGCAGTATGGGGAACCCTCGTGCTTAGCTGCAACCTTGTG CACATGTCACAGCAGTATGGGGAAGAATGTTCATTAAAGTGTTTAATTGAAG TAAATGAAAACCATAACACAGATTTTCATGGGAAGAAGATAACATGGCAAAAGTTCACA GACTGTTG CAGTTCACCATCCCCAATATGGATTCTCTGTTCAAGGAGAATATCAGGAAGAG TCTTGTTTAAAAATTACTCACTTAATGATGCAACAATTACTCTGCATAACATAGG ATTCTCTGATTCTGAAAATACATCTGCAAAGTCGTTACATTCCCGCCTTGAAAT GCCCAGTCCTCTACAACTGTAACTGTTAGTTGACCCACTGTGAGCCTGATAA AAGGGCCAGATTCTTTAATTGATGGAGGAAATGAAACAGTAGCAGCCATTTGCA TCGCAGCCACTGGAAATCCCCGTGCACATATTGACTGGGAAGGTGATCTTGGTG AAATGGAATCCACTACAAGCTTCTTTCCAAATGAAACGCAACGATTATCAGCCA GTACAAGCTATTTCCAACCAGATTTGCTACAGAGGAAGCGAATTACTTGTGTGT AAAAACATCCAGCCTTGCAAAAGAACATCCGAAACTCTTTCATTAGACATACAG TATGCTCCTGAAGTTTCGGTAACAGGATATGATGCAAATCCACCACCCTTCAAATCTG AAAGGTTAATCTCAAATGTAATGCTGATGCAATGCCTGATGGTTATTGGCTTCAGACAATA TGTGACAGGTTGATGGACCAATGCCTGATGGTTATTGGCTTCAGACAATA CTCTTCATTTTGTCATCCATTGACTTCAATTATTCTGGTGTTTATATCTGTAA AGTGACCAATTCCCTTGGTCAAAGAGTGACCAAAAAGTCATCTCATTTCAGAT GTTCCATTTAAGCAGACCTCTTCCATAGCTGTAGCTGGACTGTGCTGACTCCTCGAA AAAAAGACCATCTATCTTGACAAAGTGATTGACCTTTGCTTCACCCACCATAAACC ACCTCCTCTGTATGAAGAACATCCCCACCTTTGCCTCAGAAGAGAACCTATTTCAG CCTGAACACTTGCCTTTGCAGACTCAGTTGACGAAGTTGACTATGAAGATGAGAATCCA AGCACTCTAATGGCATTCAGCAGGACTAAATGCAGAGATTTCAGCATGAATCCAG TTGGGAAGATGGCATTCAGCAGATGCAGAGATGTACCCCCTTTACAATGTGCTACC |

SEQUENCE LISTING

| SEQ ID NO: | Name | Description | Sequence |
|---|---|---|---|
| | | | AAGACCGGAGCCCTGCAAACATCATCAAATAACGACCCTAAGAGAGTCTACA<br>TCGACCCACGAGAACATTATGTGATTTTTCTCTTTTCCAATGGGCGTTCTAA<br>CAAATGTTTATTCTTAGATTGGGAGAGAAGCTAAGGCCAATAGTTATTTTACT<br>GTCTCTCATATAAGAACAGTCCCACTCTAAGGGTATTGGAAGTCTTAATGAATGA<br>CGTAAAGCCAATAGCAAATTTCTTTTCTTCATTAAGCTTTCTAACCACCAGCT<br>GTCTTTTGTGAACTTGACTATAGCTTTGTGTTTCTGTGATGATGTATTTAACT<br>GCTAACATTTGGCCTACAATGCATTTTCATTTAACAGTACAGCATCTGCCTGTG<br>ATAACTGCAGTGATTCTCCAGAAAGAAAGGCCCCAGCTGATACTATTAACCTGT<br>TGGGTCTCAGGCATGCTAGCCTGTTCATCTGTAATTCACACAGGCATAAAAATG<br>AGTTCAGAATCTATTTCACTAATTATTAGCTGGGATTTGGATTTCCCTGACATG<br>CTTAATACAATTACAATACCTGTACAAACAGAGGCCTGAGGAAAGAGGCAAA<br>ATTGCTTTTCATCCAAACAGCAACAAAAGGCAGTTGAAACCTTCAAGCCTGTTG<br>GTTGCTTTAAACCTTTGTTATTATGAATATATTCTTTGTTGACACTATTAAATTC<br>TCCTGAGGGATACATATCTCTGCTGTTTTCTG<br>CCTACTTTTGACTAGCTGTATGTAACAAAGGCTCTACTTTTGCTCTGTCACTGTT<br>CCTACAGTCTCTGTTCTTTACTAGCTAGATTAGCCTATTTTGCACCTATTAAATTC<br>TAAAAACCTTGTTAAAAAAAAAAAAAAA |
| 586 | Human DNAM-1 | Human DNAM-1 amino acid sequence<br>NCBI Accession number: NM_006566.3<br>Uniprot accession number: Q15762<br>Protein domains annotated as follows:<br>Signal peptide (double line) (bold), extracellular domain (italic), transmembrane domain (italic) and cytoplasmatic domain (underlined)<br>Reported variant to this sequence:<br>(307) S → G | MDYPTLLLALLHVYRALCEEVLWHTSVPFAENMSLECVYPSMGILTQVEWF<br>KIGTQQDSIAIFSPTHGMVIRKPYAERVVFLNSTMASNMTLFFRNASE<br>DDVGYYSCSLYTYPQGTWQKVIQVVQSDSFEAAVPSNSHIVSEPGKNVT<br>LTCQPQMTWPVQAVRWEKIQPRQIDLLTYCNLVHGRNFTSKFPRQIVS<br>NCSHGRWSVIVIPDVVSDSGLYRCYLQASAGENETFVMRLITVAEGKTD<br>NQYTLFVAGGTVLLLFLVISITTIVIFLNRRRRERRDLFTESWDTQKAPNNYRSP<br>ISTSQPTNQSMDDTREDIYNYPTFSRRPKTRV |
| 587 | Human DNAM4 | Nucleotide sequence encoding human DNAM-1<br>NCBI Accession number: Nucleotide sequence Transcript variant 1<br>NM_0065663 | TAGAACAAAGGAGAAGTGCCTCCTTTCAAATTATAGATTCTTTGGGGGAAAAGA<br>GGGACAGAACTTTATCTGAGTTTGGAATGAGTCTGAGTAGCTGCAATAGTAAAG<br>TTGCTTCCAGAAGCACTTCAGTTGACTTCAAAAACCCCGCTTCATGAAATATT<br>AGTGATTCACTTCAGTTGCTATCTGAGGAAGTTCTGGTAGAGAGAAGAGCTCAA<br>GAGCATGGGACAGAGTCAGCTCCTGAGTGGGCTGAACGCTCCCCTCAGCTCCTGC<br>AGTGCTAATTAAGGAGGGAGGGAGCAGCGGGAGCTTGCAGTGACCAAGAGGGTGT<br>TAGGCTAGGAGGCCACGATAAACAGGATACGATAAAAGTCCTTAACCAAGACG<br>CAGATGGGAAGCAGCTTAGACGCAGCAGCACTCACATCTCAAGAACCAGCCTT<br>TCAAACAGTTTCCAGAGATGGATTATCCTACTTACTTTGCTCTTCTTCATGT |

| SEQ ID NO: Name | Description | Sequence |
|---|---|---|
| | | ATACAGAGCTCTATGTGAAGAGGTGCTTTGCATACATCAGTTCCTTTGCCGA GAACATGTCTCTAGAATGTGTATCCATCAATGGGCATCTTAACACAGGTGGA GTGGTTCAAGATCGGGACCCAGCCAGGATTCCATAGCCATTTTCAGCCCTACTCA TGGCATGGTCATAAGGAAGCCCTATGCTGAGAGGGTTACTTTTTGAATTCAAC GATGGCTTCCAATAACATGACTCTTTTCTTTCGGAATGCCTCGAAGATGATGTT GGCTACTATTCC TGCTCTCTTTACACTTACCCACAGGGAACTTGGCAGAAGGTGATACAGGTGGTT CAGTCAGATAGTTTTGAGGCAGCTGTGCCATCAAATAGCCACATTGTTTCGAA CCTGGAAAGAATGTCACACTCACTTGTCAGCCTCAGATGACGTGGCCTGTGCAG GCAGTGAGGTGGAAAAGATCCAGCCCCGTCAGATGACCTCTTAACTTACTGC AACTTGGTCCATGGCAGAAATTTCACCTCCAAGTTCCCAAGACAAATAGTGAGCA ACTGCAGCCACGGAAGGTGAGCGTCATCGTCATCCCGATGTCACAGTCTCAG ACTCGGGGCTTTACCCGCTACTTGCAGGCCAGCCAGGAGAAAACGAAACCT TCGTGATGAGATTGACTGTGACCGAGGGTAAAACCGATAACCAATATACCCTCT TTGTGGCTGGAGGGACAGTTTATTGTTGTTGTTTATCTCAATTACCACCAT CATTGTCATTTTCCTTAACAGAAGGACACCCAATAACTATAGAGTCCCATCTACC AGAGTCCTGGGATACACAGAGGCACCCAATAACTATAGAGTCCCATCTACC AGTCAACCTACCAATCAATCCATGGATGATACAAGAGGATATTTATGTCAACT ATCCAACCTTCTCTCCAGACCAAAGACTAGAGTTTAAGCTTATTCTTGACATGA GTGCATTAGTAATGACTCTTATGTACTCATGCATGATCTTTGAATTGCTTGATA GGAAAATACTTCATTACCTAAAATCATTTTTCATAGAACTGTTTCAGAAAACCT GACTCTAACTGTTTATATACAAAAGAAAACTTACTGTATCATATAACAGAATGA TCCAGGGGAGATTAAGCTTTGGGCAAGGCTATTTACCAGGGCTTAAATGTGT GTCTAGAATTAAGTATGGGCATAAACTGGCTTCTGAATCCCTTTCCAGAGTGTT GGATCCATTTCCCTGTCTTGCCTTCATCAGGCTTCCTTCCTCTTGTGTTG GCAAGATGCTGCCAACTCTTGGCAATTCATACATCCTTGTTCTGTCTGTAGA GACTTTGCTTCTCAAATGAGCAAACAAATTGATTATTTTTCATTGTTAAATA GGCAACATGACCAGAAAGGATGGAATGGCTTAAGTAAACTAAGGGTTCACTTCT AGAGCTGAGAGCAGGGTCAAAGCACAATACTGGGCAATTCAGAGCATGGTTAG AAGAGGAAGGGAGTCTCAAA GCTGAGAGAGTTTACCAACAAATATTGACTGCCAGTGATTAACCAAGACATTTTGT TAACTAAAAAGTGAAAATATGGGATGATTCTAGAAATGGGGTATCTCTGTCCAT ACTTCTAGAATCCACTCTATCACATAGTCCAGAAGAAATACCTGGCAGTAGAAGA AATGAATATTCAAGAGGAAGATAAATGCCAGGAGATAAATCCTTACTATTCTCAT ATTTATTTATCTCTCATTCTGTATAGAATTCTGCCGCATCCAGGTCTAGCCT TAGGAGCAAATGTAGTAGATAGTCGAATAATAAATAACTTAAGTTTTTGGACATA TTTTGTCTACTTTTGGAGAATTATTTTTAAATATGTAAATTCCAAAAGGGTCAG GCACCTAGTTATTTATTTTTTAATGATTATGTGAAAGTTGAATATATACCACT AAAAGTGACAGTTGAAAGTGGCATAGGACGGTAGGGTAGGAATTTGGGAG GGAAAAAGAAATTGGAGGGTACAGGCAACCAGGAGAAGGAGAATCAAACCACAG AAAAATACAAAGGGAACTTCTGCTTCACTTATTCCAGACAAAGACAGCCCTAATGA CATCACCAACAGTCAAAGCAATTAGCAACATACCTAATATGTTTAAATTCTAG ATGTAGCGTAACAATGAAAAGTATTTGCCAAACTGAATAAAACTGTCATGGTTAC CTTGAAAAAAAAAAAAAAAAAAAAAAAAAAA |

| SEQ ID NO: | Name | Description | Sequence |
|---|---|---|---|
| 588 | Human DNAM-1 | Nucleotide sequence encoding human DNAM-1 NCBI Accession number: NM_001303618.1 Nucleotide sequence Transcript variant 2 This variant (2) differs in the 5' UTR compared to variant 1. Both encode the same isoform | ATGCATGCACCACCTTTCACTTATTATTATATTTTACACTCTTATTAGTTTTC TGCCTCCTCCACATAGAATGTAAGTCTATCATGGCAATATTTTTTTTTTTGT ATTATTGTATCCTCATTGCCTACAGCTGAGTTAGCCACAGAGAATGCATGCAGC ACATGTTGTTGAATGAATGACTCCTTGTAGAAAATGAAAGCCCGAAAATAAGCC GACTGGTTCCCGAGAGAGAAACTCAAATCTGCCCATCCTCATAAAGAGC AAACCTGTCTTTTAAGCTAAGGCCTTTTCCTGTGTTCATACTTCAGAAAAGAA GACACGACTGATAACATCTGAGAGGAAGGAAACTGCATTGTGCTGGGGATCGC ATGTCACATTATAAAAAGCAATTTTTTTTTAAGAACCAGCCTTTCAAACAG TTTCAGAGATGGATTATCCTACTTTACTTTTGGCTCTTCATGTATACAGAG CTCTATGTGAAGAGTGCTTTGGCATACATCAGTTCCCTTTGCCGAGAACATGT CTCTAGAATGTGTGATCATCAATGGGCATCTTAACACAGGTGAGTGGTTCA AGATCGGACCCAGCAGGATTCCATAGCCATTTCAGCCTCATGTCATGGCATGG TCATAAGGAAGCCCTATGCTGAGAGGGTTTACTTTTTGAATTCAACGATGCTT CCAATAACATGACTCTTTTCTTCGAATGCCTCTGAAGATGATGTTGGCTACTA TTCCTGCTCTCTTACACTTACCCACAGGAACTTGGCAGAAGTGATACAGGT GGTTCAGTCAGATAGTTTGAGGCAGCTGCTGCCATCAAATAGCCACATTGTTTC GGAACCTGGAAAGAATGTCACACTCATTGTCAGCCTCAGATGACGTGCCTGT GCAGGCAGTGAGGTGGGAAAAGATCCAGCCCGTCAGATGATCCACCTCTTAACTTA CTGCAACTTGGTCCATGGCAGAAATTTCACCTCCAAGTTCCCAAGACAAATAGTG AGCAACTGCAGCCACGGAAGTGGAGCGTCATCGTCATCCCGATGTCACAGTC ACTTCGTGATGAGATTGACTGTAGCCGAGGTAAAACCGATAAACCAATATACC CTCTTGTGGCTCATTTTCCTTAACAGAGGAGAAGGAGAAGAGAGATCTAT CCATCATTGTCATTTCTGGGATACACAGAAGGCACCCAATAACTATAGAAGTCCCATCTC TTACAGAGTCCTGGGATACACAGAAGGCACCCAATAACTATAGAAGTCCCATCTC TACCAGTCAACTACCCCAATCCATGATGATCAAGAAGGATATTTATGTC AACTATCCAACCTTCTCTGCAGACCAAAGACTAGAGTTTAAGCTTATTCTTGAC ATGAGTGCATTAGTAGTGACTCTATCTGTACTCCATGCATGGATCTTTATGCAATTT TTTCCACTACCAAGGTCTACCTTAGAATACTAGTTGTCTGAATTGAGTTACTTT GATAGGAAAATACTTCATTACCTAAAATCATTTTCATAGAACTGTTTCAGAAA ACCTGACTCTAACTGGTTTATATACAAGAAAACTACTGTATCATATACAGA ATGATCCAGGGAGATTAAGCTTTGGGCAAGGCTATTACCAGGCTATTAAATG TTGTGTCTAGAATTAAGTATGGCATAAACTGGCTTCTGAATCCCTTTCCAGAGT GTTGGATCCATTTCCCTGGTCTTGGCCTCACTCTCATGCCAGGCTTTCCTCTGTG TTGGCAAGATGCCTCAACTCTTGGCCAATTCATCATCCTTGTTTCTGTCTGGT AGAGAGTTTGCTTCTCAAATGGAGCAACAAAAATTTGATTATTTTTCATTGTTAA ATAGGCAACATGACCAGAAGCAGGTCAAAGCACAATACTGGGCAATTCAGAGCATGT TCTAGAGCTGAGAAGCAGGTCAGAAGCACAATACTGGGCAATTCAGAGCATGGT TAGAAGGAAAGGGAGTCTCAAAGCTGAGAGTTTACCACACAATATTGACT GCAGTGATTAACCAAGACATTTTGTTAACTAAAAAGTGAAATATGGGATGAT TCTAGAAATGGGTATCCTGCTCCATACTTCTAGAATCCACTCTATCAGCATAGT CCAGAGAATACCTGGCAGTAGAAACATTTCAAGAAGAAGATAATAATGC GAGAGGGCAATCTTTACTATTCTCATATATTATCTCTCATTCTGTATAGAA TTCTTGCCGCCATCCCAGGTCTAGCCTTAGGAGCAAATGTAGTAGATCGAA TAATAAATAACTTAATGTTTGGACATATTTTGTCTACTTTTGAGATTATAAT AATATGTAAATTCTCAAAGGTCAGGCACCTAGTTATTATTTTTAATGATT ATGTGAAAGTTGAATATAATATACCACTAAAAGTGACAGTTGAAAGTGTGCA |

SEQUENCE LISTING

| SEQ ID NO: Name | Description | Sequence |
|---|---|---|
| 589 Human DNAM-1 | Human DNAM-1 amino acid sequence NCBI Accession number: Amino acid sequence Transcript variant 3 NM_001303619.1 | TAGGACGGTAGGGTAGAAATTTGGGAGGGAAAAAGAAATTGGGAGGGTACAG<br>GCAACAGGAGAAGGAATCAAACCACAGAAAAAATACAAAGGGAAACTTCTCTT<br>CACTATTCAGACAAAGACAGCCCTAATGACATCACCAACAGTCAAAGCAATTAGA<br>GACCATACCTAATATTGTTAAATCTAGATGTAGCTAACAATGAAAGTATTT<br>GCCAAACTGAATAAAACTGTCATGGTTACCTTGAAAAAAAAAGTATTT<br>AAAAAA<br><br>MTWPVQAVRWEKIQPRQIDLLTYCNLVHGRNFTSKFPRQIVSNCSHGRWSVIVIP<br>D<br>VIVSDSGLYRCYLQASAGENETFVMRLIVAEGKTDNQYTLFVAGGTVLLLIFVISIT<br>TIIVIFLNRRRRERRDLFTESWDTQKAPNNYRSPISTSQPTNQSMDDTREDIYVN<br>YPTFSRRPKTRV |
| 590 Human DNAM-1 | Nucleotide sequence encoding human DNAM-1 NCBI Accession number: Nucleotide sequence Transcript variant 3 NM_001303619.1 | TAGAACAAAGGAGAAGTGCGTCTTTCAAATTATAGATTCTTTGGGGAAAAGA<br>GGGACAGAACTTTATCTGAGTTTGAATGAGTCTGAGTAGCTGCAATAGTAAAG<br>TTGCTTCCAGAAGCAGGTAAACTTGACTTCAAAAACCCCGCTTCATGAAATATT<br>AGTGATTCACTTCAGTTGCTATCTGAGGAAGTTCTGGTAGAGAGAGCTCAA<br>GAGCATGGGCAGAGTCAGCTCCTGAGTGGGCTGAACGCTCCCCTCAGCTCCTGC<br>AGTGCTAATTAAGGAGGGAGGAGCAGCGGGGAGCTTGCAGTGACCAAGAGGGTGT<br>CAGAGTCTAGGAGGGCCACGATAAACAGGATACGATAAAAGTCCTTAACCAAGACG<br>CAGATGGGAAGAAGCCTTAGAGCGAGCAGCACTCACATCTCAAGATAGTTTTGA<br>GGCAGCTGTGCCATCAATAGCCACATTGTTTCGGAACCTGGAAAGAATGTCAC<br>ACTCACTTGTCAGCCTCAGATGACCTGACCTCTTAACTTACTGCAACTTGGTCTCATGCAG<br>GATCCAGCCCCGTCAGATCGACCTCTTAACTTACTGCAACTTGGTCTCATGCAG<br>AAATTT CACCTCCAAGTTCCCAAGACAAATAGTGAGCAACTTGAGATCTAAG<br>GTGGAGGTCATCGTCATCCCCGATGTCACAGTCTCAGACTCGGGCTTTACCG<br>CTGCTACTTGCCAGGCCAGCGCAGGAGGAGAAAACGAAACCTTCGTGAGATTGAC<br>TGTAGCCGAGGGTA<br>AAACCGATAACCAATATACCCTCTTTGTGGCTGCGAGGGACAGTTTTATTGTTGTT<br>GTTTGTTATCTCAATTACCACCATCATTGTCATTTTCCTTAACAGAAGGAGAGG<br>AGAGAGAAGAGATCTATTTACAGAGTCCTGGGATACACAGAAGGCACCCAAT<br>AACTATAGAAGTCCCATCTCACCAGTCAACTATCCAACCTTCTCCGACAGATGATA<br>CAAGACAGGATAATTTATGTCAACTATCCAACCTTCTCTCGCACAAAGACTAG<br>AGTTTAAGCTTATTCTTGACATGAGTGAATGATGACTCTTATGTACTCATG<br>CATGGATCTTTATGCAATTTTTTCCACTACCCAAGGTCTACCTTAGATACTAGT<br>TGTCTGAATTGAGTTACTTTGAGAAAACCTGACTAACTGGTTATATACAAAGAAAC<br>TCATAGAACTGTTTCAGAAAACTGATCCAGGGAGATTAAGCTTTGGCAAGGC<br>TTACTGTATCATATAACAGAATGATCCAGGGAGATTAAGCTTTGGCAAGGGC<br>TATTTACCAGGGCTTAAATGTTGTCTAGAATTAAGTATGGGCATAAACTGGC<br>TTCTGAATCCCTTTCCAGAGTGTTGATCCATTTCCTGGTCTTGGCCTCACTCT<br>CATGCAGGCTTGTCCTTGTGTGCCAAGATGGCTGCCAACTCTTGGCAATTCA<br>TACATCCTGTTGTTCTCTGTAGAGAGTTGCTTCTCAAATGAGCAAACAAAT<br>TTGATTATTTTTTCATTGTTAAATAGGCAACATGACCAGAAGGATGGAATGGCT<br>TAAGTAAACTAAGGGTTCACTTCTAGAGCTGAGAAGCAGGGTCAAAGCACAATA<br>CTGGGCAATTCAGAGACATGGTTAGAAGAGGAAAGGGAGTCAAAGCTGAG<br>AGTTTACCAACAAATATTGACTGCAGTGATTAACCAAGACATTTTTGTTAACTAA |

| SEQ ID NO: | Name | Description | Sequence |
|---|---|---|---|
| | | | AAAGTGAAATATGGGATGGATTCTAGAAATGGGTATCTCTGTCCATACTTCTA GAATCCACTCTATCAGCATAGTCCAGAAGAATACCTGGCAGTAGAAGAAATGAA TATTCAAGAGAAGAATAAATGCGAGAGGGCAATCCTTTACTATTCTCATATTTAT TTATCTTCATTCTGTATAGAATTCTTGCCGCCATCCAGTCTAGCCTTAGGAG CAAATGTAGATAGTGGAATAATTTTAATATGTAAATTCTCAAAGGGTCAGGCACCT CTACTTTTGAGATTATTTTTAATGATTATGTGAAAGTTGAATATAATATACCACTAAAAGT GACAGTTGAAAGTGGTGCATAGGACGGTAGGGTAGAAATTGGGAGGGAAAA AAGAAATTGGGAGGGTACAGGCAAGGAGGAAAGAATCAAACCACAGAAAAT ACAAGGGAAACTTCTGCTTCACTATTCAGCAAGACAGCCTAATGACATCAC CAACAGTCAAAGCAATTAGAGACCATAACCTAATATTGTTTAAATTCTAGATGTAG GCTAACAATGAAAAGTATTTGCCAAAC TGAATAAAACTGTCATGGTTACCTTGAAAAAAAAAAAAAAAAAAAAAAAAAAAAAA |
| 591 | Human CD96 | Human CD96 amino acid sequence NCBI Accession number: Transcript variant 1 NM_198196.2 Uniprot accession number: P40200-1 Protein domains annotated as follows: signal peptide (double line), extracellular domain (bold), transmembrane domain (italic) and cytoplasmatic domain (underlined) | MEKKWKYCAVVYIIQIHFVKGVWEKTVNTEENVYATLGSDVNLTCCQTQTVGF FVQMQWSKVTNKIDLIAVYHPQYGFYCAYGRPCESLVTFTETPENGSKW TLHLRNMSCSVSGRYECMLVLYPEGIQTKIYNLLIQTHVTADEWNSNHT IEIEINQTLEIPCFQNSSSKISSEFTYAWSVENSSTDSWVLLSKGIKEDNG TQETLISQNHLISNSTILKDRVKLGTDYRLHLSPVQIFDDGRKFSCHIRV GPNKILRSSTTVKVFAKPEIPVIVENNSTDVLVERRPTCLLKNVFPKANIT WFIDGSFLHDEKEGIYITNEERKGKDGFLELKSVLTRVHSNKPAQSDNLT IWCMALSPVPGNKVWNISSEKITFLLGSEISSTDPPLSVTESTLDTQPSP ASSVSPARYPATSSVTLVDVGSALRPNTTPQPSNSSMTTRGFNYPVVTSSG TDTKKSVSRIPSETYSSSPSGAGSTLHDNVFTSTARAFSEVPTTANGSTK TNHVHITGIVVNKPKDGMS*WPVIVAALLFCCMILFGLGVRKMCQYQKEIMERP PPFKPPPPIKYTCIQEPNESDLPYHEMETL* |
| 592 | Human CD96 | Nucleotide sequence encoding human CD96 NCBI Accession number: Transcript variant 1 NM_198196.2 | TTCCTGCTACGTTTCATTTCCTGGGGCTTGCCAAGTGATAAACAGACCCAGG CGTGTGTGGTAGAGTTCGGGTTTTTTAGCACGAAGTGGGTGGCTGGAGTTTGC TTGAAACATCAATTGACTTTGTGATCATTACAGAAATGCTGGTGTAAGGTGTTC AGAAGACAATGGAACAAATGGAAATACTGCTGCTCTATTACATCATCCAGA TACATTTTGTCAAGGAGTTTGGGAAAAAACAGTCAACACAGAAGAAATGTTT ATGCTACACTTGGCTCTGATGTCAACCTGACCTGCCAAACACAGACAGTAGGCT TCTTCGTGCAGATGCAATGGTCCAAGGTCACCAATAAGATAGACCTGATTCTG TCTATCATCCCCAATACGGCTTCTGCTGCCTATGGGACCCCTGTGAGTGCACT TGTGACTTTCACAGAAACTCCTGAGAATGGGTCAAAATGACTCTGCACTTAAG GAATATGTCTTGTTCAGTCAGGTACGAGTGTATGCTTGTTCTGTATCC AGAGGGCATTCAGACTTCAGACTAAAATCTACAACCTTCATTCAGACACACGTTACAGCA GATGAATGGAACAGCAACCATACGATAGAAATAGATAAATCAGACTCTGGAA ATACCATGCTTTCAAATAGCTCCAAAAATTTCATTCGAGTTCACCTATGCAT GGTCGGTGAAACAGCAGCACGGATTCTTGGGTCCTTCTTTCTTAAGGGTATAA AGGAGGATAATGGAACTCAGGAAACACTTATCTCCAAAATCACCTCATCAGCAA TTCCACATTACTTAAAGATAGAGTCAAGCTTGGTACAGACTGAAGTCTCTTGCCACATTAGTC GGTCCAGTCCAAATCTTGATGATGGCGGAAGTTCTTGCCACCAGTCAAGTTTTTGCTAAACCA |

| SEQ ID NO: Name | Description | Sequence |
|---|---|---|
| | | GAAATCCCTGTGATTCTGGAAAATAACTCCACGATGTCTTGGTAGAGAGAAGA |
| | | TTTACCTGCTTACTAAAGA |
| | | ATGTATTTCCAAAGCAAATATATTACTACATGTGTTTATAGATGAAGTTTCTTCATGA |
| | | TGAAAAGAAGAAATATATTACTAATGAAGAAGAGAAAGGCAAAGATGATT |
| | | TTTGGAACTGAAGTCTGTTTTAACAAGGGTACATAGTAATAAACCAGCCCAATCA |
| | | GACAACTTGACCATTTGGTGTATGGCTCTGTCCCAGTCCCAGGAAATAAAGTG |
| | | TGGAACATCTCATCAGAAAAGATCACTTTTCTCTTAGGTTCTGAAATTTCCTCAA |
| | | CAGACCCTCCACTGAGTGTTACAAGATCTACCCTTGACACCCAACCTTCTCCAGC |
| | | CAGCAGTGTATCTCCTGCAAGATATCCAGCTACATCTTCAGTGACCCTTGTAGAT |
| | | GTGAGTGCCTTGAGGCCAAACACCACTCTCAACCATCCAGTAATCCAGTATGACTA |
| | | CCCGAGGCTTCAACTATCCCTGGACCTCCAGTGGGACAGATAACCAAAAATCAG |
| | | TTTCACGGATACCTAGTGAAACATACAGTTCATCCCCGTCAGGTGCCAGGCTCAA |
| | | CACTTCATGACAATGTCTTTACCAGCACAGCCAGAGCATTTTCAGAAGTCCCCAC |
| | | AACTGCCAATGATCTACGAAAACTAATCACGTCCATATCACTGGTATTGTGGTC |
| | | AATAAGCCCAAAGATGAATGTCCTGCCAGTGATTGTAGCAGCTTTACTCTTT |
| | | TGCTCATGATATTGTTTGGTCTTGGAGTGAGAAATGGTGTCAGTACCAAAAA |
| | | GAAATAATGGAAAGACCTCCACCTTTCAAGCCACCACTCCATCAAGTACA |
| | | CTTGCATTCAAGAGCCCAACGAAAGTACTGCCTTATCATGAGATGGAGACCC |
| | | TCTAGTCTCGTGAGACTTTGCCCATGGCAGAACTCTGCTGGAATCCTATTGAG |
| | | AAGGTAGACATTGTGTCTTTATTAATATAGTGCTCTTCAGCCATGCCTTTGCTGC |
| | | AGCTGAAATGGAAGTCAGAAGTGAGTGACCTGTTTTCCCAGCAACTCACCCTCT |
| | | TCCATCTCCAAGACGCCTGAAGCTTAACCAAGAGTGAAGAGGATATGTCATGTTCA |
| | | CACTCAATGCAATTCGTAGTGTGTTTCTTGCTTATGTAAGAAGTACATATTAGTC |
| | | TGCCATCTTTAAAAAAACAGTATTTTCATTTAAATTCTCGATGGAGGGAC |
| | | AACAATGGTTCAACTGTATGCCATGCCTGATCCTCTTATTTGAACATCTATCA |
| | | ACATTGTAAACTCTTTGCCAAAATCCTGGGGCTTTGCATTCCCTAAGATAAT |
| | | TACAGGAAAAGAAATGAAATCTGTTGCTTATTTCATGAAGGAAACAGA |
| | | TATGGTTAGTCTTCATATTGAAATTGAAATTTCATGAAGGCTGTAACAAGGCTGCCAAGTAATGAGAAG |
| | | ATACTTTGCACAGGAACCACATTTTCAATCCTTCCTTCACTGTCTTCCTACCATGT |
| | | TCAGCCCAGACTCCTGCCACATGGACCAGGATGAAGAGGGATCAAAGAGATAAT |
| | | TAGCCAAAACCCAGTAGCCTAGAAGATACAAAACTCCACTGGCCTCTAAAATTA |
| | | TATTAGCCAAGAGTGGTTTCATTTGAG |
| | | TGCTTCGTGTGTATGTCCATCAAACTGGAACCAAACTGTTTTGTAAGTAACAG |
| | | GCAGGGCTAAGCCAACCTACTTTCTCAATTCCAGTTATTCTCTTTTTTCATCTGGG |
| | | GATTTACCTGTTCATTTAATCTGCCTGTTTTGATCTGTTTTGAAAAAGATAAAGA |
| | | GCCTCAAATCAGACAGCACTGATTAATTAACCCTGCTCCTACCAATCTTTTTA |
| | | AAGCAGTTGAAGCAGAATGTATAGGTTGTCAGAAGAAGAAACCTAGTCAGCCAGAC |
| | | GTGCTCTGTATTCAGCAAATAGTTTGTGAATGAATAAATTACTAATCCTAcTTGTC |
| | | GCTTGAAACCTTCCCACACTCCCCTGCTCCAGGAGGGAAAAACAGATGTTGTTGA |
| | | CAGATAGAGTGATAGGCAAATTCTGTGTGGACTTTAGTCCCAAAGGAAACTTT |
| | | AGTTCACTTGCCAGTATGCTTATCCTTGACTGCACATGAGAATGCCTGTGCAGA |
| | | GTTATTTGGAGATTATGTCTTTTTCTTAAACACCATGGCTGTCACACTTCAGTTC |
| | | AATTAAATCAGAAATGTCGAGGAGTGAGACACAGCATCAACACTCTCAAATGA |
| | | TTCACATGTTCAGCCAAAGTTGAGAACCATCGAGCCTGTGAGCCTCCAGAG |
| | | GGCTCAGAATCTTAGGTAGGTGCTTAACTCTTGTGTGGCCAGCCTCCAAGATG |
| | | AGCCCCAGTGTTCTTCTGCCTCCTACTATTCACATCTTTATGTGGTCCCCTCCAATG |
| | | CTGAATACAGATGATTTGTAACCTGAGGCCAGGATTAAGGGAGGCAATCAA |

| SEQ ID NO: | Name | Description | Sequence |
|---|---|---|---|
| | | | TGCACCTAGGAGGAAAAAATTTAAGGAGGTATTCACACTCAGGTCATGCACTTGC |
| | | | ACAATGTTGAGAATGAGTACCACTCTCCACATTGGTATAGCCAAAAAAGCTTGG |
| | | | AAGTGACCAAGGCTAGGTCACAAAATACACTGTGCTTCTTCTTTGATCTCTCTT |
| | | | TGACCATACTGACACTGGAAAAGCCCATTCCATGCACTGAAGACACCAAGGC |
| | | | AGCCCTATTGAGAAATCTACCTGTCCGGACCCAGTGGCTCACGCCTGTA |
| | | | ATCCCAGCACTTTGGGAGGCCGAGGTGGTGGATCACGAGGTCAGGAGATCGA |
| | | | GACCATCCTGGCTAACACAGTGAAACCCCGTCTCTACTAAAAATACAAAAATTA |
| | | | GCCGGGTGTGGTGTCGGGCACCTGTAGTCCCAGCTACTCAGGAGGCTGAGGCA |
| | | | GGAGAAGGGTGGAACCCGGAGGCAGAGCTTGCAGTGAGCCGAGATTGTGCC |
| | | | ACTGCACTCCAATCTGGGTGAAAGACCGAGACTCCGCCTCAAAAAAAAAAAA |
| | | | AAAGAAAGAAAGAAAGAAAGAAAGAAAATCACCTGTCAAGGAACTAAGGTATTT |
| | | | TGCTAACAAGCACCACTTGCCAGCCATGTAAGGGAGCCATCTTGGAAGCAGAT |
| | | | CCTCCAGCCTCCAGTCAAGTCTTCAGATAATTGCAACTTCAGTTGATCTTTTGAC |
| | | | CAAGACCTCAAGACCAGAACTACCCAGCTAGCCTTTTACTAAATTCTGAA |
| | | | CTTCTAACACTATTAGATAATAAGTGCTTATTGTTTAACACCATTAATTTT GAGT |
| | | | ATAATTTGTTACATAGCGACAGATAACTATACAGTCAACAACTAGAAAATAAA |
| | | | CTGTTTACCTGCCTTAATTATTTATCTTTAGTTCCTTATTAGTTCTCAAGAAACA |
| | | | AATGCTAGCTTCATATGTATGGCTGTTGCTTTGCTTCATGTGTATGCTATTTGT |
| | | | ATTTAACAAGACTTAATCATCAGTA |
| 593 | Human CD96 | Human CD96 amino acid sequence NCBI Accession number: NM_005816.4 Uniprot P40200-2 Differs from sequence Uniprot P40200-1 (Seq ID No: 591) 182-197: Missing Reported variant to this sequence: (142) A → P (280) T → M | MEKKWKYCAVVYTIQIHFVKGVWEKTVNTEENVYATLGSDVNLTCQTQWGFFVQ MQWSKVTNKIDLIAVVHPQYGFYCAYGRPCESLVIFTETPENGSKWTLHLRNMSC SVSGRYECMLVLYPEGIQTKIYNLLIQTHVTADEWNSNHTIEIEINQTLEIPCFQNSS SKISSEFTYAWSVEDNGTQETLISQNHLISNSTLLKDRVKLGTDYRLHLSPVQIFDD GRKFSCHIRVGPNKILRSSTTVKVFAKPEIPVIVENNSTDVLVERRFTCLLKNVFPKA NITWFIDGSFLHDEKRGIYITNEERKGDGFLELKSVLTRVHSNKPAQSDNLTIWC MALSPVPGNINWNISSEKITFLLGSEBISSTDPPLSVTESTLDTQPSPASSVSPARYPA TSSVTLVDVSALRPNTTPQPSNSSMTTRGFNYPVVTSSGTDIKKSVSRIPSETYSSS PSGAGSTLHDNVFTSTARAFSEVPTTANGSTKTNHVHITGIVVNKPKDGMSWPVTV AALLFCCMILFGLGVRKWCQYQKEIMERPPFKPPPPIKYTCIQEPNESDLPYHEM ETL |
| 594 | Human CD96 | Nucleotide sequence encoding human CD96 NCBI Accession number: Transcript variant 2 NM_005816.4 | TTCCTGTCTACGTTCATTCCTGGGGCTTGCCAAGTGATAAACAGACCCAGG CGTGTCGGTAGAGTTCGGTTTTTAGCACGAAGTGGGTGCTGGAGTTTGC TTGAAAACATCAATTGACTTTGTGATCATTACAGAATACTGTGGTGTAAGGTGTTC AGAAGACAATGGAGAAAAAATGGAAATACTGTCGTCTATTACATCATCCAGA TACATTTGTCAGGAGGAGTTTGGGAAAAACATCTGTCAACACAGAAGAAATGTTT ATGCTACACTTGGCTCTGATGTCAACCTGCACCTGCCAAACACAGACAGTAGGCT TCTTCGTGCAGATGCAATGGTCCAAGGTCACCAATAAGATAGACCTGATTGCTG TCTATCATCCCCAAGAATACGGCTTCTACTGGCTCTATGGGAGACCCTGTGAGTCACT TGTGACTTTCACAGAAACTCCTGAGAATGGGTCAAAATGGACTCTGCACTTAAG GAATATGTCTTGTTCAGTGAGGTACGAGTGTATGCTTGTTCTGTATCC AGAGGGCATTCAGACTAAATCTACAACCTTCTCATTCAGACACACGTTACAGCA GATGAATGGAACAGCAACCATACGATAGAAATAGAGATAAATCAGACTCTGAA ATACCATGCTTTCAAAATAGCTCCTCAAAATTTCATCTGAGTTCACCTATGCAT |

| SEQ ID NO: Name | Description | Sequence |
|---|---|---|
| | | GGTCGTGAGGATAATGGAACTCAGGAGAACACTTATCTCCAAAATCACCTCA |
| | | TCAGCAATTCCACATTACTTAAAGATAGAGTCAAGCTTGGTACAGACTAGACT |
| | | CCACCTCCTTCCAGTCCAAATCTTCGATGATGGGCGAAGTTCTCTTGCCACATT |
| | | AGAGTCGGTCCTAACAAAATCTTGAGGAGTCCACCACAGTCAAGGTTTTGCT |
| | | AAACCAGAAATCCCTGAATTGTGAAAATAACTCCACGATGTCTTGGTAGAG |
| | | AGAAGATTACTGCTTACTAAAGATGTATTTCCAAAGCAAATCACATGGT |
| | | TTATAGATGAAGTTTCTTCATGATGAAAAGAAGGAATATATATTACTAATGA |
| | | AGAGAGAAAGGCAAAGATGGATTTTTGGACTGAAGTCTGTTTTAACAGGGT |
| | | ACATAGTAATAAACCAGCCAATCAGACAACTGACCATTTGGTATGGCTCTG |
| | | TCTCCAGTCCCAGAATAAAGTGTGAACATCTCATCAGAAAGATCACTTTTC |
| | | TCTTAGGTTCTGAAATTTCCTCAACAGACCCTCCACTGAGTGTTACAGAATCTAC |
| | | CCTTGACACCCAACTTCTCCAGCCAGCAGTGTATCTCTGCAAGACATATCCAGCT |
| | | ACATCTTCAGTGACCCTGTAGATGTGAGTGCCTTGAGGCCAAACACCACTCCTC |
| | | AACCCAGCAATTCCAGTATGACTACCCGAGCTCAACTATCCCTGGACTCCCAG |
| | | TGGGACAGATACCAAAAATCAGTTTCACGGATACCTAGTGAAACATACAGTTCA |
| | | TCCCCGTCAGTGCAGGCTCAACACTTCATGACAATGTCTTTACCAGCAGCCA |
| | | GAGCATTTTCAGAAGTCCCCACAAGTCGTCAATAAGCCAATGATCTACGAAAACTAATCACGT |
| | | CCATATCACTGGTATTGTGGTCAATAAGACACTTGTCATGATATTGTTTGGTCTTGGAGTGAG |
| | | GATTGTAGCAGCTTTACTCTTTTGCTGCATGATATTGTTTGGTCTTGGAGTGAG |
| | | AAAATGTGTCAGTACCAAAAGAATAATGGAAAGACCTCCACCTTTCAAGCCA |
| | | CCACACCTCCATCAGTAGGAGACCCTCTAGTCTCTGAACATGGAAGTGATCTGC |
| | | CTTATCATGAGAGTGGAGACCCCTTAGTCTCTGAACATGGAAGTGATCTGC |
| | | CTCTGCTGGAATCCTATTGAGAAGGTAGACATTGTGCTTATTAATAATAGTCGT |
| | | CTTCAGCCATGCCCTTTGCTGCAGCTGAAATGGAAGTCAGAAGTGAGTGACCTGT |
| | | TTTCCAGCAACTCACCCTTTCCATCTCAACGCCTGAAGCTTAACCAAGAGT |
| | | GAGAGATATGTCATGTTCACACTCCAATGCAATTCGTAGTTGGTTTTCTTGCTTAT |
| | | GTAAGAAGTACATATTAGTCTGCCATCTTAAAAAAAAATACAGTATTTTCATTT |
| | | AAATTCTCTGATGGAGGGAACAACAATGGTTTCAACTGTATGCCCATGCCTGATC |
| | | CTCTTATTTGAACATCTAACAATTCAACATTGTAAACTCTTTGCCAAAATCCTGGGCTT |
| | | TGCTGCATTCCCTAAGATAATTACGGAAAAAGAAAATGTAAAAGTGCTAACAAG |
| | | GCTGCCAAGTAATGGAGAAGTATGGTTAGTCTTC |
| | | ATATTGAAATTCTGTTGCTTATTTCATGGAAGGAAAACAGAATACTTTGCACAGG |
| | | AACCACATTTTCAATCCTCTTCACTGTCTTCCTACCATGTTCAGCCCAGACTCC |
| | | TGCCACAGGACCAGGATGAAGACGGATCAAAGAGATAATTAGCCAAAAACCCA |
| | | GTAGCCTAGAAGATACAAAACTCCACTGGCCTCTAAAATTATATTAGCCAAGAGT |
| | | GGTTTCATTTGAGTGCCTTCGTGTATGTCATCAAACTGGAACCAAACTGTTT |
| | | TGTAAGTAACAGGGAGCCTTACCTGTCATTTAATCTGCCTGTTTTGATCTGTTTTG |
| | | TTTTTCATCTGGGGATTTACCTGTCATTTAATCTGCCTGTTTTGATCTGTTTTG |
| | | AAAAAGATAAAGAGCCTCAAATCAGACCAGCATGATTAATTAACCCTGCTCCTA |
| | | CCAATCTTTTTTAAAGCAGTTGAAGCAGAAGTATGAGGTGTCAGAGAAGAAACC |
| | | TAGTCAGCCAGACGTGCTCTGTATTCAGCAATAGTTGTGAATGAATAAATTACT |
| | | AATCCTCCTTGTCGCTTGACAACTCCCACACTCCCTGCTCCAGGAGGGAAAAAC |
| | | AGATGTTGTTGACAGTAGAGTGAATAGGCAAATTCTGTGGACTTTAGTCCA |
| | | AAAGGAAACTTTAGTTCACTTGCAGTTATTTGGAGATTATGTCTTTTTCTTAAACACCATGGCTGTCA |
| | | CCTTGTGCAGATTATTTGGAGATTATGTCTTTTTCTTAAACACCATGGCTGTCA |
| | | CACTTCAGTTCAATTAAATCAGAATGTCTGAGGAGTGAGACACAGGCATCAACA |
| | | CTCTCAAATGATTCACATGTTCAGCCAAGTTCAGCCATGCCCAAAGTTGAGAACCATCGAGCCTGTGAA |

| SEQ ID NO: | Name | Description | Sequence |
|---|---|---|---|
| | | | GTTCTTTCTCATGGCTCAGAATCTTAGGTAGTGCTTAACTCTTGTGGTGCCA GCCTCCAAGATGAGCCCCAGTGTTCTTGCCTCCTACTATTCACATCTTTATGTGG TCCCCTCCAATGCTGAATACAGATGATTTGTGTAACCTGAGGCCAGGATTAAGG GGAGGCAATCAATGCACCTAGGGAAAAAATTTAAGGAGGTATTCACTCAGGG TCATGCACTTGCACATGTTGAGAATGACTACCACTCCACCATTGGTATAGCCA AAAAGCTTGGAAGTGACCAAGGCTAGGTCACAAAATACACTGTGGCTTCTCT TTGATCTCTCTTTGACCATACTGACACTGGAGAAAGCCATTCCCATGCCATGAA GACACCAAGGCAGCCCTATTGAGAAATCTACCTGTCGTGCCGGGCCAGTGGC TCACGCCTGTAATCCCAGCA CTTTGGGAGGCCGAGGTGGGTGGATCACGAGGTCAGGAGATCGAGACCATCCT GGCTAACACAGTGAAACCCCGTCTCTACTAAAAATACAAAAATTAGCCGGGTGT GGTGTCGGGCACCTGTAGTCCCAGCTACTCAGGAGGCTGAGGCAGGAGAAGG TGGGAACCCGGGAGGCAGAGCTTGCAGTGAGCCGAGATTGTGCCACTGCACAC TCCAATCTGGGTGAAAGACCGAGACTCCGCCTCAAAAAAAAAAAAAAAGAAAG AAAGAAAGAAAGAAAGAAATCTACCTGTCAAGGAACTAAGGTATTTTGCTAACAA GCACCAACTTGCCAGCCATGTAAGGGAGCCATCTTCAGTTGATCTTTGACCAGACCTC AGAGAGCCAGAACTACCCAGCTAAGCTCTTTTACTAAATTTCTGAACTTCTAACA CTATTAGTAATAAGTGCTATTGTTTATTGTTTAAACATCAATTAATTTGAGTATAATTTGT TACATAGGACAGATAACTATACAGCTCAACAACTAGAAAATAAACTGTTTACC TGCCTTAATTATTTATTCTTAGTTCTTATTAGTTCTCAAGAAACAAATGCTAGC TTCAATATGTATGGCTGCTTCTTGCTTCATGTGATGGCTATTTGTATTTAACAA GACTTAATCATCAGTA |
| 595 | Human CD96 | Human CD96 amino acid sequence NCBI Accession number: Transcript variant 3 NM_001318889.1 | MEKKWKYCAVVYIIQIHFVKGVWEKTVNTEENVYATLGSDVNLTCQTQTVGFFVQ MQWSKVTNKIDLIAVVHPQYGFYCAYGRPCESLVTFTETPENGSKINTLHLRNMSC SVSGRYECMLVLYPEGIQTKIYNLLIQTHVTADEWNSNHTIEIEINQTLEIPCFQNSS SKISSEFTYAWSVEDNGTQETLISQNHLISNSTLLKDRVKLGTDYRLHLSPVQIFDD GRKFSCHIRVGPNKILRSSTTVKVFAKPEIPVIVENNSTDVLVERRFTCLLKNVFPKA NITWFIDGSFLHDEKEGIYIINEERKGKDGFLELKSVLTRVHSNKPAQSDNLTIWC MALSPVPGNKVWNISSEKITFLLGSEISSTDPPLSVTESTLDTQPSPASSVSPASKNV FTLsY |
| 596 | Human CD96 | Nucleotide sequence encoding human CD96 NCBI Accession number: Transcript variant 3 NM_001318889.1 | TTCCTGTCTACGTTTCATTTCTGGGGCTTGCCAAGTGATAAACAGACCCAGG CGTGTGGTAGAGTTCGGGTTTTTAGCACGAAGTGGGTGGCTGGAGTTTGC TTGAAAACATCAATTGACTTTGTGATCATTACAGAATCTGGTCTATTACATCATCAGA AGAAGACAATGGAGAAAAATGGAAATACTGTCTGTCTATTACATCACAGA TACATTTTGTCAAGGAGTTTGGGAAAAAACAGTCAACACAGAAGAAATGTTT ATGCTACTTGCTCTGATGTCAACCTGACCTGCCAAACACAGACAGTAGGCT TCTTCGTGCAGATGCAATGGTCCAAGGTCACCAATAAGATAGACCTGATTGCTG TCTATCATCCCAATACGGCTTCTACTGTGCCTATGGGAGACCCTGAGTCACT TGTGACTTTCACAGAAACTCCTGAGAATGGGTCAAAATGGACTCTGCACTTAAG GAATATGTCTGTTCTCAGTCAGTGAAGGTACGCAGTGTATGCTTGTTCTGTATCC AGAGGGCATTCAGAACTAAAATCAGACTAGAAATCAGATAATCAGACTCTGGAA GATGAATGGAACAGCAACCATACGATAGAAATTCATCTGAGTTCACLTATGCAT ATACCATGCTTTCAAAATAGCTCCTCAGAAACACTTATCTCCAAATCACCTCA GGTCGGTGGAGGATAATGAACTCAGGAACTCAGGAAAACACTTATCTCCAAATCACCTCA |

SEQUENCE LISTING -continued

| SEQ ID NO: | Name | Description | Sequence |
|---|---|---|---|
| | | | TCAGCAATTCCACATTACTTAAAGATAGAGTCAAGCTTGGTACAGACTACAGACT CCACCTCTCCTCCAGTCCAAATCTTCGATGATGGGCCGGAAGTTCTCTTGCCACATT AGAGTCGGTCCTAACAAATCTTGAGGAGCTCCACCACAGTCAAGTTTTTGCT AAACCAGAAATCCCTGATTGTGGAAAAATAACTCACGGATGTCTTGGTAGAG AGAAGATTTACCTGCTTACTAAAGATGTATTTCCCAAAGCAAATATCACATGGT TTATAGATGGAAGTTTTC TTCATGATGAAAAAGAAGGAATATATATTACTAATGAAGAGAGAAAGGCAAAG ATGGATTTTGGAACTGAAGTCTGTTTTAACAAGGTACATAGTAATAACCAG CCCAATCAGACAACTTGACCATTTGGTCTATGGCTCTGTCTCCAGTCCCAGGAAA TAAAGTGTGGAACATCTCATCAGAAAAGATCACTTTCTTCTCCAGTTCTGAAATT TCCTCAACAGACCCCTCCACTGAGTGTTACAGAATCTACCCTTGACACCCAACCTT CTCCAGCCAGCAGTGTATCCTCCAGTAAGAATGTTTTCACACTGAGCTATTG ATTTAACCAAGCAGATTGATAACGATAAAATTTCAGCAAACTTGCATCATTCATG CCTGTTTCTTAGCTACTATGACTTTTTTGGGCTGCACTTTTGTCTATTTTTTAACA GCTTTATTGAGATATAATTCACGTCACATTACTTGCCCATTTAAAATGTATGAT CTAATGGTTTTTAGTATGTTCACAGACTTGTACAACCATGACTACAGCCAATTTC AGAACATTTTCATCATCTAATAAAGAAACTCCTAAACAAAAAAAAAAAAAAA |
| 597 | KY01-CDRH1 (IMGT) of KY01 using IMGT | Amino Acid sequence of CDRH1 | GFTFDDYG |
| 598 | KY01-CDRH2 (IMGT) of KY01 using IMGT | Amino Acid sequence of CDRH2 | ISWNSVTI |
| 599 | KY01-CDRH3 IMGT) of KY01 using IMGT | Amino Acid sequence of CDRH3 | AKDGGLRYYYGMDV |
| 600 | KY01-CDRH1 (Kabat) of KY01 using Kabat | Amino Acid sequence of CDRH1 | DYGMY |
| 601 | KY01-CDRH2 (Kabat) of KY01 using Kabat | Amino Acid sequence of CDRH2 | GISWNSVTIGYADSVKG |
| 602 | KY01-CDRH3 (Kabat) of KY01 using Kabat | Amino Acid sequence of CDRH3 | DGGLRYYYGMDV |
| 603 | KY01-V$_H$ | Amino acid sequence of KY01 heavy chain variable region | EVQLVESGGGLVQPGRSLRLSCAASGFTFDDYGMYWVRQTPGKGLEWVSGISWN SVTIGYADSVKGRFTISRDNAKNSLYLQMNSLRAEDTALYYCAKDGGLRYYYGMDV WGQGTKVTVSS |
| 604 | KY01-V$_H$ | Nucleic acid sequence of KY01 heavy chain variable region | GAAGTGCAGCTGGTGGAGTCTGGGGGAGGCTTGGTACAGCCTGGCAGGTCCCT GAGACTCTCCTGTGCAGCCTCTGGATTCACCTTTGATGATTATGGCATGTACTG GGTCCGGCAAACTCCAGGGAAGGGCCTGGAGTGGGTCTCAGGTATTAGTTGGA ATAGTGTTACCATAGGCTATGCGACTCTGTGAAGGGCCGATTCACCATCTCCA GAGACAACGCCAAGAACTCCCTGTATCTGCAAATGAACAGTCTGAGAGCTGAGG ACACGGCCTTGTATTACTGTGCAAAAGATGGIGGCTTGAGTATTACTACGGTA TGGACGTCTGGGGCCAAGGGACCAAGGTCACCGTCTCCTCA |

SEQUENCE LISTING - continued

| SEQ ID NO: | Name | Description | Sequence |
|---|---|---|---|
| 605 | KY01-heavy chain | Amino acid sequence of KY01 heavy chain | EVQLVESGGGLVQPGRSLRLSCAASGFTFDDYGMWVRQTPGKGLEWVSGISWN SVTIGYADSVKGRFTISRDNAKNSLYLQMNSLRAEDTALYYCAKDGGLRYYYGMDV WGQGTKVTVSSASTKGPSVFPLAPCSRSTSESTAALGCLVKDYFPEPVTVSWNSGA LTSGVHTFPAVLQSSGLYSLSSVVTVPSSSLGTKTYTCNVDHKPSNTKVDKRVESKY GPPCPPCPAPEFEGGPSVFLFPPKPKDTLMISRTPEVTCVVVDVSQEDPEVQFNWY VDGVEVHNAKTKPREEQFNSTYRVVSVLTVLHQDWLNGKEYKCKVSNKGLPSSIEK TISKAKGQPREPQVYTLPPSQEEMTKNQVSLTCLVKGFYPSDIAVEWESNGQPENN YKTTPPVLDSDGSFFLYSRLTVDKSRWQEGNVFSCSVMHEALHNHYTQKSLSLSLG K |
| 606 | KY01-heavy chain | Nucleic acid sequence of KY01 heavy chain | GAAGTGCAGCTTGGTGGAGTCTGGGGGAGGCTTGGTACAGCCTGGCAGGTCCCT GAGACTCTCCTGTGCAGCCTCTGGATTCACCTTTGATGATTATGGCATGTACTG GGTCCGCCAAACTCCAGGGAAGGGCCTGGAGTGGGTCTCAGGTATTAGTTGGA ATAGTGTTACCATAGGCTATGCGGACTCTGTGAAGGGCCGATTCACCATCTCCA GAGACAACGCCAAGAACTCCCTGTATCTGCAAATGAACAGTCTGAGAGCTGAGG ACACGGCCTTGTATTACTGTGCAAAAGATGGCTTGAGTATTACTACGGTA TGGACGTCTGGGGCCAAGGGACCACGGTCACCGTCTCCTCAGCCAGCCAAGG GCCCTTCCGTGTTCCCCCTGGCGCCCTGCTCCAGCAGGACCACTCCGAATCCACAG CTGCCCTGGGCTGCCTGGTCAAGGACTACTTTCCCGAGCCTGTGACCGTGAGCT GGAACAGCGGCGCTCTACTCCCTGTCCTCCGTGGTGACCGTGCCTAGCTCCTCG GCACCAAGACCTACACGTGCAACGTGGATCACAAGCCTCCAACACCAAGGTGG ACAAACGGGTCGAGAGCAAGTACGGCCCCTCCTGTCCCCTGTCCTGTGCCCCG AGTTCGAAGGCGGACCGGACACCCGAGGTGACCTGCGTATGTGGATGGCGTGGAGGTGCACAA GAGGACCCTGAGGTCCAGTTCAACTGGTATGTGGATGGCGTGGAGGTGCACAA CGCCAAGACAAAGCCCCGGGAAGAGCAGTTCAACTCCACCTACAGGGTGGTCAG CGTGCTGACCGTGCTGCATCAGGACTGGCTGAACGGCAAGGAGTACAAGTGCAA GGTCAGCAATAAGGGACTGCCCAGCAGCATCGAGAAGACCATCTCCAAGGCTAA AGGCCAGCCCCGGGAACCTCAGGTGTACACCCTGCCTCCGTGTACCCTTCCGA GACCAAGAACCAGGTGAGCCTGACCTGCCTGGTCAAGGGATTCTACCCTTCGA CATCGCCGTGGAGTGGGAGTCCAACGGCCAGCCCGAGAACAATTATAAGACCAC CCCTCCCGTCCTGGACAGCGACGGATCCTTCTTTCTGTACTCCAGGCTGACCGT GGATAAGTCCAGGTGGCAGGAAGGCAACGTGTTCAGCTGCTCCGTGATGCACGA GGCCCTGCACAATCACTACACCCAGAAGTCCCTGAGCCTGTCCCTGGGAAAG |
| 607 | KY01-CDRL1 (IMGT) | Amino acid sequence of CDRL1 of KY01 using IMGT | QSLLHSNGYNY |
| 608 | KY01-CDRL2 (IMGT) | Amino acid sequence of CDRL2 of KY01 using IMGT | LDS |
| 609 | KY01-CDRL3 (IMGT) | Amino acid sequence of CDRL3 of KY01 using IMGT | MQALRTPLT |
| 610 | KY01-CDRL1 (Kabat) | Amino acid sequence of CDRL1 of KY01 using Kabat | RSSQSLLHSNGYNYLA |

-continued

SEQUENCE LISTING

| SEQ ID NO: | Name | Description | Sequence |
|---|---|---|---|
| 611 | KY01-CDRL2 (Kabat) | Amino acid sequence of CDRL2 of KY01 using Kabat | LDSNRAS |
| 612 | KY01-CDRL3 (Kabat) | Amino acid sequence of CDRL3 of KY01 using Kabat | MQALRTPLT |
| 613 | KY01-V_L | Amino acid sequence of KY01 light chain variable region | DIVMTQSPLSLSVTPGESASISCRSSQSLLHSNGYNYLAWYLQKPGQSPQLLIYLDS NRASGVPDRFSGSGSGTDFTLKISRVEAEDVGIYYCMQALRTPLTFGGGTKVEIK |
| 614 | KY01-V_L | Nucleic acid sequence of KY01 light chain variable region | GATATTGTGATGACTCAGTCTCCACTCTCCCTGTCCGTCACCCTGGAGAGTCG GCCTCCATCTCTGCAGGTCAGGTCAGAGCCTCCTGCATAGTAATGGATACAACT ATTTGGCTTGGTACCTGCAGAAGCCAGGGCAGTCTCCACAGCTCCTGATCTATT TGGATTCTAATCGGGCCTCCGGGGTCCCTGACAGGTTCAGTGGCAGTGGATCAG GCACAGATTTTACACTGAAAATCAGCAGAGTGGAGGCTGAGGATGTTGGGATTT ATTACTGCATGCAAGCTCTGCGAACTCCGCTCACTTTCGGCGGAGGGACCAAGG TGGAGATCAAA |
| 615 | KY01-light chain | Amino acid sequence of KY01 light chain | DIVMTQSPLSLSVTPGESASISCRSSQSLLHSNGYNYLAWYLQKPGQSPQLLIYLDS NRASGVPDRFSGSGSGTDFTLKISRVEAEDVGIYYCMQALRTPLTFGGGTKVEIKR TVAAPSVFIFPPSDEQLKSGTASVVCLLNNFYPREAKVQWKVDNALQSGNSQESVT EQDSKDSTYSLSSTLTLSKADYEKHKVYACEVTHQGLSSPVTKSFNRGEC |
| 616 | KY01-light chain | Nucleic acid sequence of KY01 light chain | gATATTGTGATGACTCAGTCTCCACTCTCCCTGTCCGTCACCCTGGAGAGTCG GCCTCCATCTCTGCAGGTCAGGTCAGAGCCTCCTGCATAGTAATGGATACAACT ATTTGGCTTGGTACCTGCAGAAGCCAGGGCAGTCTCCACAGCTCCTGATCTATT TGGATTCTAATCGGGCCTCCGGGGTCCCTGACAGGTTCAGTGGCAGTGGATCAG GCACAGATTTTACACTGAAAATCAGCAGAGTGGAGGCTGAGGATGTTGGGATTT ATTACTGCATGCAAGCTCTGCGAACTCCGCTCACTTTCGGCGGAGGGACCAAGG TGGAGATCAAACGTACGGTGGCTGCCCCATCTGTCTTCATCTTCCCACCTTCCG ACGAGCAGCTGAAGTCCGGAACTGCCAGCGTGGTGTGCCTGCTGAACAACTTCT ACCCCCGCGAGGCCAAGGTGCAGTGGAAGGTGGACAACGCCCTGCAGTCCGGC AACTCCCAGGAATCCGTGACCGAGCAGGACTCCAAGGACAGCACCTACTCCCTG TCCTCCACCCTGACCCTGTCCAAGGCCGACTACGAGAAGCACAAGGTGTACGCC TGCGAAGTGACCCACCAGGGCCTGTCTAGCCCCGTGACCAAGTCTTTCAACCGG GGCGAGTGT |
| 617 | KY02-CDRH1 (IMGT) | Amino Acid sequence of CDRH1 of KY02 using IMGT | GFTFSDYY |
| 618 | KY02-CDRH2 (IMGT) | Amino Acid sequence of CDRH2 of KY02 using IMGT | ISSSGSTV |
| 619 | KY02-CDRH3 (IMGT) | Amino Acid sequence of CDRH3 of KY02 using IMGT | ARDRGFGESYCFDY |
| 620 | KY02-CDRH1 (Kabat) | Amino Acid sequence of CDRH1 of KY02 using Kabat | DYYMS |

-continued

SEQUENCE LISTING

| SEQ ID NO: | Name | Description | Sequence |
|---|---|---|---|
| 621 | KY02-CDRH2 (Kabat) | Amino Acid sequence of CDRH2 of KY02 using Kabat | YISSSGSTVYSADSVKG |
| 622 | KY02-CDRH3 (Kabat) | Amino Acid sequence of CDRH3 of KY02 using Kabat | DRGFGESYCFDY |
| 623 | KY02-V$_H$ | Amino acid sequence of KY02 heavy chain variable region | QVPLVESGGGLVRPGGSLRLSCAASGFTFSDYYMSWIRQAPGKGLEWVSYISSSGS TVYSADSVKGRFTVSRDNAKSSLLLHMNSLRAEDTAIYYCARDRGFGESYCFDYW GQGTLVTVSS |
| 624 | KY02-V$_H$ | Nucleic acid sequence of KY02 heavy chain variable region | CAGGTGCCGCTGGTGGAGTCTGGGGGAGGCTTGGTCAGGCCTGGAGGGTCCCT GAGACTCTCCTGTGCAGCCTCTGGATTCACCTTCAGTGACTACTACATGAGCTG GATCCGCCAGGCTCCAGGGAAGGGGCTGGAGTGGGTTTCATACATTAGTAGTA GTGGTAGTACCGTGTATTCCGCAGACTCTGTGAAGGGCCGATTCACCGTCTCCA GGGACAACGCCAAGAGCTCACTGCTTCTGCACATGAACAGCCTGAGAGCCGAGG ACACGGCCATATATTACTGTGCAGAGATAGAGGGTTCGGGGAGTCCTATTGCT TTGACTACTGGGGCCAGGGAACCCTGGTCACCGTCTCCTCA |
| 625 | KY02-heavy chain | Amino acid sequence of KY02 heavy chain | QVPLVESGGGLVRPGGSLRLSCAASGFTFSDYYMSWIRQAPGKGLEWVSYISSSGS TVYSADSVKGRFTVSRDNAKSSLEHMNSLRAEDTAIYYCARDRGFGESYCFDYW GQGTLVTVSSASTKGPSVFPLAPCSRSTSESTAALGCLVKDYFPEPVTVSWNSGALT SGVHTFPAVLQSSGLYSLSSVVTVPSSSLGTKTYTCNVDHKPSNTKVDKRVESKYG PPCPPCPAPEFEGGPSVFLFPPKPKDTLMISRTPEVTCVVVDVSQEDPEVQFNWYV DGVEVHNAKTKPREEQFNSTYRVVSVLTVLHQDWLNGKEYKCKVSNKGLPSSIEKT ISKAKGQPREPQVYTLPPSQEEMTKNQVSLTCLVKGFYPSDIAVEWESNGQPENNY KTTPPVLDSDGSFFLYSRLTVDKSRWQEGNVFSCSVMHEALHNHYTQKSLSLSLGK |
| 626 | KY02-heavy chain | Nucleic acid sequence of KY02 heavy chain | CAGGTGCCGCTGGTGGAGTCTGGGGGAGGCTTGGTCAGGCCTGGAGGGTCCCT GAGACTCTCCTGTGCAGCCTCTGGATTCACCTTCAGTGACTACTACATGAGCTG GATCCGCCAGGCTCCAGGGAAGGGGCTGGAGTGGGTTTCATACATTAGTAGTA GTGGTAGTACCGTGTATTCCGCAGACTCTGTGAAGGGCCGATTCACCGTCTCCA GGGACAACGCCAAGAGCTCACTGCTTCTGCACATGAACAGCCTGAGAGCCGAGG ACACGGCCATATATTACTGTGCAGAGATAGAGGGTTCGGGGAGTCCTATTGCT TTGACTACTGGGGCCAGGGAACCCTGGTCACCGTCTCCTCAGCCTCCACCAAGG GCCCTTCCGTCTTCCCCCTGGCGCCCTGCTCCAGGAGCACCTCCGAATCCACAG CTGCCCTGGGCTGTCTGGTGAAGGACTACTTTCCCGAGCCCGTGACCGTGAGCT GGAACAGCGGCGCCCTCACCAGCGGCGTCCACACCTTTCCTGCCGTCCTGCAGT CCTCCAGCGCCCTCACCGTCCTGGGTGACCGTGCCTAGCTCCTCCTCG GCACCAAGACCTACACCTGTAACGTGGACCACAAACCTTCCAACACCAAGTGG ACAAACGGTCGAGAGCAAGTACGGCCCTCCTGTCCCTCCTGTCCTGCCCCG AGTTCGAAGGCGGACCCAGCGTGTTCCTGTTCCCTCCAAGCCCAAGGACACCC TCATGATCAGCCGGACCCCAGAGGTGACCTGCGTGGTGGTGGATGTGAGCCAG GAGGACCCTGAGGTGCAGTTCAACTGGTATGTGGATGGCGTGGAGGTGCACAA CGCCAAGACAAAGCCCCGGGAAGAGCAGTTCAACTCCACCTACAGGGTGGTCAG CGTGCTGACCGTGCTGCATCAGGACTGGCTGAACGGCAAGGAGTACAAGTGCAA GGTCAGCAATAAGGGACTGCCCAGCAGCATCGAGAAGACCATCTCCAAGGCTAA AGGCCAGCCCCGGGAACCTCAGGTGTACACCCTGCCTCCCAGCCAGGAGGAGAT |

| SEQ ID NO: | Name | Description | Sequence |
|---|---|---|---|
| | | | GACCAAGAACCAGGTGAGCCTGACCTGCCTGGTGAAGGGATTCTACCCTTCCGA CATCGCCGTGGAGTGGGAGTCCAACGGCCAGCCCGAGAACAATTATAAGACCAC CCCTCCCGTCCTCGACAGCGACGGATCCTTCTTTCTGTACTCCAGGCTGACCGT GGATAAGTCCAGGTGGCAGGAAGGCAACGTGTTCAGCTGCTCCGTGATGCACGA GGCCCTGCACAATCACTACACCCAGAAGTCCCTGAGCCTGTCCCTGGGAAAG |
| 627 | KY02-CDRL1 (IMGT) | Amino acid sequence of CDRL1 of KY02 using IMGT | QNIRSY |
| 628 | KY02-CDRL2 (IMGT) | Amino acid sequence of CDRL2 of KY02 using IMGT | TAS |
| 629 | KY02-CDRL3 (IMGT) | Amino acid sequence of CDRL3 of KY02 using IMGT | QQSYSIPCS |
| 630 | KY02-CDRL1 (Kabat) | Amino acid sequence of CDRL1 of KY02 using Kabat | RASQNIRSYLT |
| 631 | KY02-CDRL2 (Kabat) | Amino acid sequence of CDRL2 of KY02 using Kabat | TASSLQS |
| 632 | KY02-CDRL3 (Kabat) | Amino acid sequence of CDRL3 of KY02 using Kabat | QQSYSIPCS |
| 633 | KY02-V$_L$ | Amino acid sequence of KY02 light chain variable region | DIQMTQSPSSLSASVGDRVTITCRASQNIRSYLTWYQQKPGKAPKLLIYTASSLQS GVPSRFSGSGSGTDFLTISSLQPEDFATYYCQQSYSIPCSFGQGTKLEIK |
| 634 | KY02-V$_L$ | Nucleic acid sequence of KY02 light chain variable region | GACATCCAGATGACCCAGTCTCCATCCTCCCTGTCTGCATCTGTAGGAGACAGA GTCACCATCACTTGCCGGGCAAGTCAGAACATTAGGAGTTATTTAACTTGGTAT CAGCAGAAACCAGGGAAAGCCCCTAAGCTCCTGATCTATACTGCATCCAGTTAC AAAGTGGGTCCCATCAAGGTTCAGTGGCAGTGGATCTGGGACAGATTTCACTC TCACCATCAGCAGTCTGCAACCTGAAGATTTTGCAACTTATTACTGTCAACAGAG TTACAGTATCCCGTGCAGTTTTGGCCAGGGGACCAAGCTGGAGATCAAA |
| 635 | KY02-light chain | Amino acid sequence of KY02 light chain | DIQMTQSPSSLSASVGDRVTITCRASQNIRSYLTWYQQKPGKAPKLLIYTASSLQS GVPSRFSGSGSGTDFLTISSLQPEDFATYYCQQSYSIPCSFGQGTKLEIKRIVAAP SVFIFPPSDEQLKSGTASVVCLLNNFYPREAKVKWKVDNALQSGNSQESVTEQDSK DSTYSLSSTLTLSKADYEKHKVYACEVTHQGLSSPVTKSFNRGEC |
| 636 | KY02-light chain | Nucleic acid sequence of KY02 light chain | GACATCCAGATGACCCAGTCTCCATCCTCCCTGTCTGCATCTGTAGGAGACAGA GTCACCATCACTTGCCGGGCAAGTCAGAACATTAGGAGTTATTTAACTTGGTAT CAGCAGAAACCAGGGAAAGCCCCTAAGCTCCTGATCTATACTGCATCCAGTTAC AAAGTGGGTCCCATCAAGGTTCAGTGGCAGTGGATCTGGGACAGATTTCACTC TCACCATCAGCAGTCTGCAACCTGAAGATTTTGCAACTTATTACTGTCAACAGAG TTACAGTATCCCGTGCAGTTTTGGCCAGGGGACCAAGCTGGAGATCAAACGTAC GGTGGCCGCGCTCCGTCCTTCATCTTCCCACCTTCCGACGAGCAGCTGAAGTC CGGCACCGCTTCTGTGTGCCTGCTGAACAACTTCTACCCCCGCGAGGCCAA |

| SEQ ID NO: | Name | Description | Sequence |
|---|---|---|---|
| | | | GGTGCAGTGGAAGGTGGACAACGCCCTGCAGTCCGGCAACTCCCAGGAATCCGT GACCGAGCAGGACTCCAAGGACTCCAAGAACACCCTGTACCTGCAGATGAGCAGCCTG GTCCAAGGCCGACTACGAGAAGCACAGAAGTGTACGCCTGCGAAGTGACCCACCA GGGCCTGTCTAGCCCCGTGACCAAGTCTTTCAACCGGGGCGAGTGT |
| 637 | KY03-CDRH1 (IMGT) | Amino Acid sequence of CDRH1 of KY03 using IMGT | GFTFSNAW |
| 638 | KY03-CDRH2 (IMGT) | Amino Acid sequence of CDRH2 of KY03 using IMGT | IKSKANGGTT |
| 639 | KY03-CDRH3 (IMGT) | Amino Acid sequence of CDRH3 of KY03 using IMGT | VIDPLYDILTGY |
| 640 | KY03-CDRH1 (Kabat) | Amino Acid sequence of CDRH1 of KY03 using Kabat | NAWMS |
| 641 | KY03-CDRH2 (Kabat) | Amino Acid sequence of CDRH2 of KY03 using Kabat | RIKSKANGGTTDYAAPVKG |
| 642 | KY03-CDRH3 (Kabat) | Amino Acid sequence of CDRH3 of KY03 using Kabat | DPLYDILTGY |
| 643 | KY03-V$_H$ | Amino acid sequence of KY03 heavy chain variable region | EVQLVESGGDLVKPGGSLRLSCAASGFTFSNAWMSWVRQAPGKGLEWVGRIKSK ANGGTTDYAAPVKGSFTISRDDSKNTLYLQMSSLKTEDTAVYYCVIDPLYDILTGY WGRGTLVTVSS |
| 644 | KY03-V$_H$ | Nucleic acid sequence of KY03 heavy chain variable region | GAGGTGCAGCTGGTGGAGTCTGGGGGAGACTTGGTCAAGCCTGGGGGGTCCCT TAGACTCTCCTGTGCAGCCTCTGGATTCACTTTCAGTAACGCCTGGATGAGCTG GGTCCGCCAGGCTCCAGGGAAGGGCTGGAGTGGGTTGGCCGTATTAAAAGCA AAGCTAATGGTGGAACAACAGACTACGCTGCACCCGTGAAAGGCAGTTTCACCA TCTCAAGAGATGATTCAAAAAACACGCTGTATCTGCAAATGAGCAGCCTGAAAAC CGAGGACACAGCCGTGTATTATTGTGTTATAGACCCCCTTTACGATATTTTGACT GGATACTGGGGCCGGGAACCCTGGTCACCGTCTCCTCA |
| 645 | KY03-heavy chain | Amino acid sequence of KY03 heavy chain | EVQLVESGGDLVKPGGSLRLSCAASGFTFSNAWMSWVRQAPGKGLEWVGRIKSK ANGGTTDYAAPVKGSFTISRDDSKNTLYLQMSSLKTEDTAVYYCVIDPLYDILTGY WGRGTLVTVSSASTKGPSVFPLAPCSRSTSESTAALGCLVKDYFPEPVTVSWNSGA LTSGVHTFPAVLQSSGLYSLSSVVTVPSSSLGTKTYTCNVDHKPSNTKVDKRVESKY GPPCPPCPAPEFEGGPSVFLFPPKPKDILMISRTPEVTCVVVDVSQEDPEVQFNWY VDGVEVHNAKTKPREEQFNSTYRVVSVLTVLHQDWLNGKEYKCKVSNKGLPSSIEK TISKAKGQPREPQVYTLPPSQEEMTKNQVSLTCLVKGFYPSDIAVEWESNGQPENN YKTTPPVLDSDGSFFLYSRLTVDKSRWQEGNVFSCSVMHEALHNHYTQKSLSLSLG K |

-continued

SEQUENCE LISTING

| SEQ ID NO: | Name | Description | Sequence |
|---|---|---|---|
| 646 | KY03-heavy chain | Nucleic acid sequence of KY03 heavy chain | GAGGTGCAGCTGGTGGAGTCTGGGGGAGACTTGGTCAAGCCTGGGGGTCCCT TAGACTCTCCTGTGCAGCCTCTGGATTCACTTTCAGTAACGCCTGGATGAGCTG GGTCCGCCAGGCTCCAGGGAAGGGCTGGAGTGGGTTGGCCGTATTAAAAGCA AAGCTAATGGTGGAACAACAGACTACGCTGCACCCGTGAAAGGCAGTTTCACCA TCTCAAGAGATGATTCAAAAAACACGCTGTATCTGCAAATGAGCAGCCTGAAAAC CGAGGACACAGCCGTGTATTATTGTGTTATAGACCCCCTTTACGATATTTGACT GGATACTGGGGCCGGGGAACCCTGGTCACCGTCTCCTCAGCCAGCACCAAGGGC CCTTCCGTGTTCCCCCTGGCCTGTTCTGTGAAGGACTACTTTCCCGAGCCTGTGA CCGTGTCCTGGAACAGCGGCGCCCTGACCAGCGGCGTGCACACCTTCCCAGCT GCCCTGGGCTGTCTGTACACCGTGTCCAGCGTCCTCCTGTCCTCCTGAGCTGG AACAGCGGCGTCTGACATCCGGGTCCACACCTTTCCTGCCGTCCTGAGTGTCC TCCGGCCTCTACTCCCTGTCCTCCGTGGTGACCGTGCCTAGCTCCTCCCTGGC ACCAAGACCTACACCTGTAACGTGGACCACAAGCCCTCCAACACCAAGGTGGACA AACGGGTCGAGAGCAAGTACGGCCCCTCCTGCCCTCCTTGCTGTCCTGCCCCAGT TCGAAGGCGACCCAGCGTGTTCCTGTTCCCTCCTAAGCCAAGGACACCCTCA TGATCAGCCGGACACCCGAGGTGACCTGCGTGGTGGTGGATGTGAGCCAGGAG GACCCTGAGGTCCAGTTCAACTGGTATGTGGATGGCGTGGAGGTGCACAACGCC AAGACAAAGCCCCGGGAAGAGCAGTTCAACTCCACCTACAGGGTGGTCAGCGTG CTGACCGTGCTGCATCAGGACTGGCTGAACGGCAAGGAGTACAAGTGCAAGGTC AGCAATAAGGACTGCCCAGCAGCATCGAGAAGACCATCTCCAAGGCTAAAGGC CAGCCCCGGGAACCCCAGGTGTACCCCTGCCCTGGTGAAGGATTCTACCCTTCC GACATC AAGAACCAGGTGAGCCTGACCTGCCTGGTGAAGGGCTTCTACCCTTCCGACATC GCCGTGGAGTGGGAGTCCAACGGCCAGCCCGAGAACAATTATAAGACCACCCCT CCCGTCCTCGACAGCGACGGATCCTTCTTTCTGTACTCCAGGCTGCCTGTGGAT AAGTCCAGGTGGCAGGAAGCCAGGAAGGCAACCTGTTCAGCTGCTCCGTGATGCACGAGGC CCTGCACAATCACTACACCCAGAAGTCCCTGAGCCTGTCCCTGGGAAAG |
| 647 | KY03-CDRL1 (IMGT) | Amino acid sequence of CDRL1 of KY03 using IMGT | KLGDKY |
| 648 | KY03-CDRL2 (IMGT) | Amino acid sequence of CDRL2 of KY03 using IMGT | QDS |
| 649 | KY03-CDRL3 (IMGT) | Amino acid sequence of CDRL3 of KY03 using IMGT | QAWDSSTAV |
| 650 | KY03-CDRL1 (Kabat) | Amino acid sequence of CDRL1 of KY03 using Kabat | SGDKLGDKYAC |
| 651 | KY03-CDRL2 (Kabat) | Amino acid sequence of CDRL2 of KY03 using Kabat | QDSKRPS |
| 652 | KY03-CDRL3 (Kabat) | Amino acid sequence of CDRL3 of KY03 using Kabat | QAWDSSTAV |
| 653 | KY03-V_L | Amino acid sequence of KY03 light chain variable region | SYDLTQPPSVSVSPGQTASITCSGDKLGDKYACWYQQKPGQSPVLVIYQDSKRPS GIPERFSGSNSGNTATLTISGTQAMDEADYYCQAWDSSTAVFGGGTKLTVL |

-continued

SEQUENCE LISTING

| SEQ ID NO: | Name | Description | Sequence |
|---|---|---|---|
| 654 | KY03-V<sub>L</sub> | Nucleic acid sequence of KY03 light chain variable region | TCCTATGACCTGACTCAGCCACCCTCAGTGTCCGTGTCCCCAGGACAGACAGCC<br>AGCATCACCTGCTCTGGAGATAAATTGGGGGATAAATATGCTTGTTGGTATCAG<br>CAGAAGCCAGGCCAGTCCCCTGTGCTGGTCATCTATCAAGATAGTAAGCGCCCC<br>TCAGGGATCCCTGAGCGATTCTCTGGCTCCAATTCTGGGAACACAGCCACTCTG<br>ACCATCAGCGGGACCCAGGCTATGATGAGGCTGACTATTACTGTCAGGCGTGG<br>GACAGCAGCACTGCGGTTTTGCGGCGAGGGACCAAGCTGACCGTCCTA |
| 655 | KY03- light chain | Amino acid sequence of KY03 light chain | SYDLTQPPSVSVSPGQTASITCSGDKLGDKYACWYQQKPGQSPVLVIYQDSKRPS<br>GIPERFSGSNSGNTATLTISGTQAMDEADYYCQAWDSSTAVFGGGTKLTVLGQPK<br>AAPSVTLFPPSSEELQANKATLVCLISDFYPGAVTVAWKADSSPVKAGVETTTPSKQ<br>SNNKYAASSYLSLTPEQWKSHRSYSCQVTHEGSTVEKTVAPTECS |
| 656 | KY03- light chain | Nucleic acid sequence of KY03 light chain | TCCTATGACCTGACTCAGCCACCCTCAGTGTCCGTGTCCCCAGGACAGACAGCC<br>AGCATCACCTGCTCTGGAGATAAATTGGGGATAAATATGCTTGTTGGTATCAG<br>CAGAAGCCAGGCCAGTCCCAGTCCCTGTGCTGGTCATCTATCAAGATAGTAAGCGCCCC<br>TCAGGGATCCCTGAGCGATTCTCTGGCTCCAATTCTGGGAACACAGCCACTCTG<br>ACCATCAGCGGACCCAGGCTATGATGAGGCTGACTATTACTGTCAGGCGTGG<br>GACAGCAGCACTGCGGTTTTCCGGAGGGACCAAGCTGACCGTCCTAGGTCA<br>GCCCAAGGCTGCCCCCTCGGTTGCACTCTGTTCTCATAAGTGACTTCTACCCGGAGCCT<br>AGCCAACAAGGCCACACTGTGTGTCTCATAAGTGACTTCTACCCGGAGCTTCA<br>GACAGTGGCCTGGAAGGCAGATAGCAGCCCCGTCAAGGCGGGAGTGGAGACCA<br>CCACACCCTCCAAACAAGCCACCAACCAAGTACGCGCCAGCAGCTATCTGAGCCT<br>GACGCCTGAGCAGTGAGAAGTCCAACAGAAGTACCAGCTGCCAGTCACGCATGA<br>AGGGAGCACCGTGGAGAAGACAGTGGCCCCTACAGAATGTTCA |
| 657 | KY04-CDRH1 (IMGT) | Amino Acid sequence of CDRH1 of KY04 using IMGT | GDSISSSNW |
| 658 | KY04-CDRH2 (IMGT) | Amino Acid sequence of CDRH2 of KY04 using IMGT | IYHSGNT |
| 659 | KY04-CDRH3 (IMGT) | Amino Acid sequence of CDRH3 of KY04 using IMGT | ARARVDILTGRGYYGMDV |
| 660 | KY04-CDRH1 (Kabat) | Amino Acid sequence of CDRH1 of KY04 using Kabat | SSNWWS |
| 661 | KY04-CDRH2 (Kabat) | Amino Acid sequence of CDRH2 of KY04 using Kabat | EIYHSGNTNYNPSLKS |
| 662 | KY04-CDRH3 (Kabat) | Amino Acid sequence of CDRH3 of KY04 using Kabat | ARVDILTGRGYYGMDV |
| 663 | KY04-V<sub>H</sub> | Amino acid sequence of KY04 heavy chain variable region | QVQLQESGPGLVRPSGTLSLTCAVSGDSISSSNWWSWVRQPPGKGLEWIGEIYHS<br>GNTNYNPSLKSRGTISVDKSKNQFSLKLTSITAADTAVYYCARARVDILTGRGYYG<br>MDVWGQGTTVTVSS |

| SEQ ID NO: | Name | Description | Sequence |
|---|---|---|---|
| 664 | KY04-V$_H$ | Nucleic acid sequence of KY04 heavy chain variable region | CAGGTGCAGCTGCAGGAGTCGGGCCCAGGACTGGTGAGGCCTTCGGGACCCT GTCCCTCACCTGCGCTGTCTCTGGTGACTCCATCAGCAGTAGTAACTGGTGAG TTGGTTCCGCCAGCCCCAGGGAAGGGCTGGAGTGGATTGGGAGAATCTATC ATAGTGGGAACACCAACTACAATCCGTCCCTCAAGAGTCGAGGCACCATTCAG TAGACAAGTCCAAGAACCAGTTCTCCCTGAAGCTGAGCTCTGTGACCGCCGCGG ACACGGCCGTATATTACTGTGCGAGAGCGAGGGTTTACGATATTTGACTGTC GAGGTTACTACGGTATGGACGTCTGGGGCCAAGGGACCACGGTCACCGTCTCCT CA |
| 665 | KY04-heavy chain | Amino acid sequence of KY04 heavy chain | QVQLQESGPGLVRPSGTLSLTCAVSGDSISSSNWSWVRQPPGKGLEWIGEIYHS GNTNYNPSLKSRGTISVDKSKNQFSLKLTSITAADTAVYYCARARVYDILTGRGYYG MDVWGQGTTVTVSSASTKGPSVFPLAPCSRSTSESTAALGCLVKDYFPEPVTVSW NSGALTSGVHTFPAVLQSSGLYSLSSVVTVPSSSLGTKTYTCNVDHKPSNTINDKR VESKYGPPCPAPEFEGGPSVFLFPPKPKDTLMISRTPEVTCVVVDVSQEDPEVQ FNWYVDGVEVHNAKTKPREEQFNSTYRVVSVLTVLHQDWLNGKEYKCKVSNKGL PSSIEKTISKAKGQPREPQVYTLPPSQEEMTKNQVSLTCLVKGFYPSDIAVEWESNG QPENNYKTTPPVLDSDGSFFLYSRLTVDKSRWQEGNVFSCSVMHEALHNHYTQKS LSLSLGK |
| 666 | KY04-heavy chain | Nucleic acid sequence of KY04 heavy chain | CAGGTGCAGCTGCAGGAGTCGGGCCCAGGACTGGTGAGGCCTTCGGGACCCT GTCCCTCACCTGCGCTGTCTCTGGTGACTCCATCAGCAGTAGTAACTGGTGAG TTGGGTCCGCCAGCCCCAGGGAAGGGCTGGAGTGGATTGGGAGAATCTATC ATAGTGGGAACACCAACTACAATCCGTCCCTCAAGAGTCGAGGCACCATTCAG TAGACAAGTCCAAGAACCAGTTCTCCCTGAAGCTGACCTCTATAACCGCCGCGG ACACGGCCGTATATTACTGTGCGAGAGCGAGGGTTTACGATATTTGACTGGTC GAGGTTACTACGGTATGGACGTCTGGGGCCAAGGGACCACGGTCACCGTCTCCT CAGCCAGCACTACGAAGGCCCTTCTCCGTTTCCCCCTGGCCCTGCCTGCAGCAGGACA CCTCCGAATCCACAGCTGCCCTGGGCTGTCTGGTGAAGGACTACTTTCCCGAGC CCGTGACCGTGAGCTGGAACAGCGGCGCGCTCTACTCCCTGGCGTCCACACCTTTC CTGCCCTCCTGCAGTCCTCCGGCCTCAGTCCGTAACGTGACCACCAAACCCTC CTAGCTCTCCCTCGGCACCAAGACCTACACCTGTAACGTGGACCACAAACCCTC CAACACCCAAGGTGGACAAACGGGTCGAGAGCAAGTACGGCCCTCCGTGCCCTCC TTGTCCTGCCCCGAGTTCGAAGGCGGACCCAGCGTGTTCCTGTTCCCTCCTAA GCCAAGGACACCCTCATGATCAGCCGGACTCCTGAGGTGACCTGCGTGGTGGT GGATGTGAGCCAGGAGGACCCTGAGGTGCAGTTCAACTGGTATGTGGATGGCG TGGAGGTGCACAACGCCAAGACAAAGCCCCGGGAAGAGCAGTTCAACTCCACCT ACAGGGTGGTCAGCGTGCTGACCGTGCTGCACCAGGACTGGCTGAACGGCAAG GAGTACAAGTGCAAGGTCAGCAATAAGGGACTGCCCAGCAGCATCGAGAAGACC ATCTCCAAGGCTAAAGGCCAGCCCCGGGAACCTCAGGTGTACACCCTGCCTCCC AGCCAGGAGGAGATGACCAAGAACCAGGTGAGCCTGACCTGCCTGGTGAAGGG ATTCTACCCTTCCGACATCGCCGTGGAGTGGAGTCCAACGGCCAGCCCGAGAA CAATTATAAGACCACCCCTCCCGTCCTGGACAGCGATGGATCCTTCTTCTTGTAC TCCAGGCTGACCGTGGATAAGTCCAGGTGGCAGGAAGGCAACGTGTTCAGCTGC TCCGTGATGCACGAGGCCCTGCACAATCACTACACCCAGAAGTCCCTGAGCCTG TCCCTGGGAAAG |

-continued

SEQUENCE LISTING

| SEQ ID NO: | Name | Description | Sequence |
|---|---|---|---|
| 667 | KY04-CDRL1 (IMGT) | Amino acid sequence of CDRL1 of KY04 using IMGT | ALPKKY |
| 668 | KY04-CDRL2 (IMGT) | Amino acid sequence of CDRL2 of KY04 using IMGT | EDR |
| 669 | KY04-CDRL3 (IMGT) | Amino acid sequence of CDRL3 of KY04 using IMGT | FSTDSSGNPRV |
| 670 | KY04-CDRL1 (Kabat) | Amino acid sequence of CDRL1 of KY04 using Kabat | SGDALPKKYAY |
| 671 | KY04-CDRL2 (Kabat) | Amino acid sequence of CDRL2 of KY04 using Kabat | EDRKRPS |
| 672 | KY04-CDRL3 (Kabat) | Amino acid sequence of CDRL3 of KY04 using Kabat | FSTDSSGNPRV |
| 673 | KY04-V$_L$ | Amino acid sequence of KY04 light chain variable region | SYELTQPPSVSVSPGQTARITCSGDALPKKYAYWYQQKSGQAPVLVIHEDRKRPSG IPERFSGSSSGTMATLTISGAQVEDEADYYCFSTDSSGNPRVFGGGTKLTVL |
| 674 | KY04-V$_L$ | Nucleic acid sequence of KY04 light chain variable region | TCCTATGAGCTGACACAGCCACCCTCGGTGTCAGTGTCCCCAGGACAAACGGCC AGGATCACCTGCTCTGGAGATGCATTGCCAAAAAAGTATGCTTATTGGTACCAG CAGAAGTCAGGCCAGGCCCCTGTTCTGGTCATCCATGAGGACAGAAAGCGACCC TCCGGGATCCCAGAGATTCTCTGGCTCCAGCTCAGGGACAGCTGACCACCTTG ACTATCAGTGGAGCCCAGGTGGAGGATGAAGCTGACTACTACTGTTTCTCAACA GACAGCAGTGGTAATCCTAGGGTGTTCGGCGGAGGGACCAAGCTGACCGTCCTA |
| 675 | KY04-light chain | Amino acid sequence of KY04 light chain | SYELTQPPSVSVSPGQTARITCSGDALPKKYAYWYQQKSGQAPVLVIHEDRKRPSG IPERFSGSSSGTMATLTISGAQVEDEADYYCFSTDSSGNPRVFGGGTKLTVLGQPK AAPSVTLFPPSSEELQANKATLVCLISDFYPGAVTVAWKADSSPVKAGVETTTPSKQ SNNKYAASSYLSLTPEQWKSHKSYSCQVTHEGSTVEKTVAPTECS |
| 676 | KY04-light chain | Nucleic acid sequence of KY04 light chain | TCTGAGGCCTCCTATGAGCTGACACAGCCACCCTCGGTGTCAGTGTCCCCAGGA CAAACGGCCAGGATCACCTGCTCTGGAGATGCATTGCCAAAAAAGTATGCTTAT TGGTACCAGCAGAAGTCAGGCCAGGCCCCTGTTCTGGTCATCCATGAGGACAGG AAACGACCCTCCGGGATCCTATCAGTGGGGCCCAGGTGGAGGATGAAGCTGAAT GCCACCTTGACTATCAGTGGAGCCCAGGTGAAGGATGAAGCTGACTACTACTGT TTCTCAACAGACAGCAGTGGTAATCCTAGGGTGTTCGGCGGAGGGACCAAGCTG ACCGTCCTAGGTCAGCCCAAGGCAGCACCCTCACTGGTGCTCATAAGTGACTTCT CTGAGGAGCTTCAAGCAAACAAAGCCACACTGGTGTGTCTCATAAGTGACTTCT ACCCGGAGGCCGTGACAGTGGCCTGGAAGGCAGATAGCAGCCCCGTCAAGGCG GGAGTGGAGACCACCACACCCTCCAAACAAGCAACACAAGTACGGCCAGC AGCTACCTGAGCCTGACGCCTGAGCAGTGAAGTCCACAAAAGCTACAGCTGC CAGGTCACGCATGAAGGAGCACCCGTGGAGAAGACAGTGGCCCCTACAGAATGT TCA |

SEQUENCE LISTING

| SEQ ID NO: | Name | Description | Sequence |
|---|---|---|---|
| 677 | KY05-$V_H$ | Amino acid sequence of KY05 heavy chain variable region | EVQLVESGGGLVQPGRSLRLSCAASGFTFDDYAMHWVRLGPGRGLEWVSRISWN SGSTDYADSVKGRFTISRDNAKNSLFLQMNSLRTEDTALWCAKERTPAGITVAGF DYWGQGSLVTVSS |
| 678 | KY05-$V_H$ | Nucleic acid sequence of KY05 heavy chain variable region | GAAGTGCAACTGGTGGAGTCTGGGGGAGGCTTGGTACAGCCTGGCAGGTCCT GAGACTCTCCTGCAGCCTCTGGATTCACCTTTGATGATTATGCCATGCACTG GGTCCGGCTAGGTCCAGGGAGGGGCCTGGAGTGGGTCTCACGTATTAGTTGGA ATAGTGGTTCCACAGACTATGCGGACTCTGTGAAGGGCCGATTCACCATCTCCA GAGACAACGCCAAGAACTCCCTCTTTCTGCAAATGAACAGTCTGAGAACTGAGG ACACGGCCTTGTATTACTGTGCAAAAGAACCCCGCGGTATAACAGTGG CTGGTTTTGACTACTGGGGCCAGGGATCCCTGGTCACCGTCTCCTCA |
| 679 | KY05-$V_L$ | Amino acid sequence of KY05 light chain variable region | DIVMTQSPLSLPVTPGEPASISCRSSQSLLHSNGFNYLDWYLQKPGQTPQLLIYLVS TRASGVPDRFSGSGSGTDFTLKISRVEAEDVGVFYCMQALQTPCSFGQGTKLEIK |
| 680 | KY05-$V_L$ | Nucleic acid sequence of KY05 light chain variable region | GATATTGTGATGACTCAGTCTCCACTCTCCCTGCCCGTCACCCCTGGAGAGCCG GCTTCCATCTCCTGCAGGTCTAGTCAGAGCCTCCTGCATAGTAATGGATTCAACT ATTTGATTGGTACCTGCAGAAGCCAGGGCAGACTCCACAACTCCTGATCTATT TGGTTTCTACTCGGGCCTCCGGGGTCCCTGACAGGTTCAGTGGCAGTGGATCAG GCACAGATTTTACACTGAAAATCAGCAGAGTGGAGGCTGAGGATGTTGGGGTTT TTTACTGCATGCAAGCTCTACAAACTCCGTGCAGTTTTGGCCAGGGGACCAAGC TGGAGATCAAA |
| 681 | KY06-$V_H$ | Amino acid sequence of KY06 heavy chain variable region | EVQLVESGGGLVQPGRSLRLSCAASGFTFDAYALHWVRLGPGRGLEWVSRISWNS GSIDYADSVKGRFTISRDNAKNSLYLQMNSLRTEDTALYYCAKERTPAGITVAGFD FWGQGTLVTVSS |
| 682 | KY06-$V_H$ | Nucleic acid sequence of KY06 heavy chain variable region | GAAGTGCAACTGGTGGAGTCTGGGGGAGGCTTGGTACAGCCTGGCAGGTCCT GAGACTCTCCTGTGCAGCCTCTGGATTCACCTTTGATGCTTATGCCTTGCACTG GGTCCGGCTAGGTCCAGGGAGGGGCCTGGAGTGGGTCTCACGTATTAGTTGGA ATAGTGGTTCATTGACTATGCGGACTCTGTGAAGGGCCGATTCACCATCTCCA GAGACAACGCCAAGAACTCCCTGTATCTGCAAATGAACAGTCTGAGAACTGAGG ACACGGCCTTGTATTACTGTGCAAAAGAAGAACCCCGCGGTATAACAGTGG CTGGTTTTGACTTCTGGGGCCAGGGGACCCTGGTCACCGTCTCCTCA |
| 683 | KY06-$V_L$ | Amino acid sequence of KY06 light chain variable region | DIVMTQSPLSLPVTPGEPASISCRSSQSLLHSNGFNYLDWYLQKPGQTPQLLIYLVS TRASGVPDRFSGSGSGTDFTLKISRVEAEDVGVFYCMQALQTPCSFGQGTKLEIK |
| 684 | KY06-$V_L$ | Nucleic acid sequence of KY06 light chain variable region | GATATTGTGATGACTCAGTCTCCACTCTCCCTGCCCGTCACCCCTGGAGAGCCG GCCTCCATCTCCTGCAGGTCTAGTCAGAGCCTCCTGCATAGTAATGGATTCAACT ATTTGATTGGTACCTGCAGAAGCCAGGACAGACTCCACAACTCCTGATCTATTT GGTTTCTACTCGGGCCTCCGGGGTCCCTGACAGGTTCAGTGGCAGTGGATCAG GCACAGATTTTACACTGAAAATCAGCAGAGTGGAGGCTGAGGATGTTGGGGTTT TTTACTGCATGCAAGCTCTACAGACTCCGTGCAGTTTTGGCCAGGGGACCAAGC TGGAGATCAAA |

-continued

SEQUENCE LISTING

| SEQ ID NO: | Name | Description | Sequence |
|---|---|---|---|
| 685 | KY07-V$_H$ | Amino acid sequence of KY07 heavy chain variable region | EVQLVESGGDLVQPGRSLRLSCAASGFTFDDYAMHWVRLGPGRGLEWVSRISWN SGSIDYADSVKGRFTISRDNAKNSLYLQMNSLRTEDTALYYCAKERTPAGITVAGF DYWGQGTLVTVSS |
| 686 | KY07-V$_H$ | Nucleic acid sequence of KY07 heavy chain variable region | GAAGTGCAGCTGGTGGAGTCTGGGGGAGACTTGGTACAGCCTGGGCAGGTCCCT GAGACTCTCCTGTGCAGCCTCTGGATTCACCTTTGATGATTATGCCATGCACTG GGTCCGGCTAGGTCCAGGGAGGGGCCTGGAGTGGGTCTCACGTATTAGTTGGA ATAGTGGTTCTATAGACTATGCGGACTCTGTGAAGGGCCGATTCACCATCTCCA GAGACAACGCCAAGAACTCCCTGTATCTGCAAATGAACAGTCTGAGAACTGAGG ACACGGCCTTGTATTACTGTGCAAAAGAACCCCGCGGGTATAACAGTGG CTGGTTTTGACTACTGGGGCCAGGGAACCCTGGTCACCGTCTCCTCA |
| 687 | KY07-V$_L$ | Amino acid sequence of KY07 light chain variable region | DIVMTQSPLSLPVTPGEPASISCRSSQSLLHSNGFNYLDWYLQKPGQTPQLLIYLVS TRASGVPDRFSGSGSGTDFTLKISRVEAEDVGVFYCMQALQTPCSFGQGTKLEIK |
| 688 | KY07-V$_L$ | Nucleic acid sequence of KY07 light chain variable region | GATATTGTGATGACTCAGTCTCCACTCTCCCTGCCCGTCACCCTGGAGAGCCG GCCTCCATCTCCTGCAGGTCTAGTCAGAGCCTCCTACAGAGCCTCCTACAACTCCAACT ATTTGATTGGTACCTGCAGAAGCCAGGGCAGACTCCACAACTCCTGATCTATT TGGTTTCTACTCGGGCCTCCGGGTCCCTGACAGGTTCAGTGGCAGTGGATCAG GCACAGATTTTACACTGAAAATCAGCAGAGTGGAGGCTGAGGATGTTGGGGTTT TTTACTGCATGCAAGCTCTACAAACTCCGTCCAGTTTTGGCCAGGGGACCAAGC TGGAGATCAAA |
| 689 | KY08-V$_H$ | Amino acid sequence of KY08 heavy chain variable region | EVQLVESGGDLVQPGRSLRLSCAASGFTFDDYAMHWVRLGPGRGLEWVSRISWN SGSIDYADSVKGRFTISRDNAKNSLYLQMNSLRTEDTALYYCAKERTPAGITVAGF DYWGQGTLVTVSS |
| 690 | KY08-V$_H$ | Nucleic acid sequence of KY08 heavy chain variable region | GAAGTGCAGCTGGTGGAGTCTGGGGGAGGCTTGGTACAGCCTGGCAGGTCCT GAGACTCTCCTGTGCAGCCTCTGGATTCACGTTTGATGATTATGCCATGCACTG GGTCCGGCTAGGTCCAGGGAGGGGCCTGGAGTGGGTCTCACGTATTAGTTGGA ATAGTGGTTCTATAGACTATGCGGACTCTGTGAAGGGCCGATTCACCATCTCCA GAGACAACGCCCTGTATTACTGTGCAAAGAACCCCGGGTATAACAGTGG CTGGTTTTGACTACTGGGGCCAGGGAACCTGGTCACCGTCTCCTCA |
| 691 | KY08-V$_L$ | Amino acid sequence of KY08 light chain variable region | DIVMTQSPLSLPVTPGEPASISCRSSQSLLHSNGFNYLDWYLQKPGQTPQLLIYLVS TRASGVPDRFSGSGSGTDFTLKISRVEAEDVGVFYCMQALQTPCSFGQGTKLEIK |
| 692 | KY08-V$_L$ | Nucleic acid sequence of KY08 light chain variable region | GATATTGTGATGACTCAGTCTCCACTCTCCCTGCCCGTCACCCTGGAGAGCCG GCCTCCATCTCCTGCAGGTCTAGTCAGAGCCTCCTGCATAGTAATGGATTCAACT ATTTGGATTGTACCTGCAGAAGCCAGGGCAGACTCCACAACTCCTGATCTATT TGGTTTCTACTCGGGCCTCCGGGTCCCTGACAGGTTCAGTGGCAGTGGATCAG GCACAGATTTTACACTGAAATCAGCAGAGTGGAGGATGTTGGGGTTT TTTACTGCATGCAAGCTCTACAAACTCCGTCCAGTTTTGGCCAGGGGACCAAGC TGGAGATCAAA |

SEQUENCE LISTING - continued

| SEQ ID NO: | Name | Description | Sequence |
|---|---|---|---|
| 693 | KY09-$V_H$ | Amino acid sequence of KY09 heavy chain variable region | EVQLVESGGGLVKPGGSLRLSCAASGFTFSNAWMSWVRQAPGKGLEWVGRIKSKT NGGTTDYAAPVKGRFTISRDDSKNTLYLQMNSLKTEDTAVYCCTIDPLYDILTGPW GQGTLVTVSS |
| 694 | KY09-$V_H$ | Nucleic acid sequence of KY09 heavy chain variable region | GAGGTGCAGCTGGTGGAGTCTGGGGGAGGCTTGGTAAAGCCTGGGGGGTCCCT TAGACTCTCCTGTGCAGCCTCTGGATTCACTTTTAGTAACGCCTGGATGAGCTG GGTCCGCCAGGCTCCAGGGAAGGGACTGGAGTGGGTTGGCCGTATTAAAGCA AACTAATGGTGGACAACAGACTACGCTGCACCCCTGAAAGGCAGATTCACCA TCTCAAGAGATGATTCAAAAAACACGCTGTATCTGCAAATGAACAGCCTGAAAAC CGAGGACACAGCCGTTTATTGTGTACCATAGACAGCCCTCTATGATATTTTGACT GGTCCCTGGGGCCAGGGACCCTGGTCACCGTCTCCTCA |
| 695 | KY09-$V_L$ | Amino acid sequence of KY09 light chain variable region | PYELTQAPSVSVSPGQAASITCSGDKLGDKYACWYQQKPGQSPVLVIYQDSKRPSG IPERFSGSNSGNTATLTISGTQAMDEADYYCQAWDSSTVVFGGGTKLTVL |
| 696 | KY09-$V_L$ | Nucleic acid sequence of KY09 light chain variable region | CCCTATGAACTGACTCAGGACACCCTCAGTGTCCGTGTCCCAGGACAGGCAGCC AGCATCACCTGCTCTGGAGATAAATTGGGGGATAAATATGCTTGCTGGTATCAG CAGAAGCCAGGCCAGTCCCCTGTCCTCATCTATCAAGATAGCAAGCGGCCC TCAGGGATCCCTGAGCGATTCTCTGGCTCCAATTCTGGGAACACAGCCACTCTG ACCATCAGCGGACCCAGGTATGAGGCTGACTATTACTGTCAGGCGTGG GACAGCAGCACTGTGGTTTCGGCGGAGGGACCAAGCTGACCGTCCTA |
| 697 | KY10-$V_H$ | Amino acid sequence of KY10 heavy chain variable region | EVQLVESGGGLVKPGGSLRLSCAASGFTFSYAMMSWVRQAPGKGLEMWVGRIKSKT NGGTTDYAAPVKGRFTISRDDSKDTLYLLMNSLKTEDTAVYYCTIDPLYDLLTGPW GQGTLVTVSS |
| 698 | KY10-$V_H$ | Nucleic acid sequence of KY10 heavy chain variable region | GAGGTGCAGCTGGTGGAGTCTGGGGGAGGCTTGGTAAAGCCTGGGGGGTCCCT TAGACTCTCCTGTGCAGCCTCTGGATTCACTTTTAGTTACGCCTGGATGAGCTG GGTCCGCCAGGCTCCAGGGAAGGGGCTGGAGTGGGTTGGCCGTATTAAAGCA AACTAATGGTGGACACAGACTACGCTGCACCCGTGAAAGGCAGATTCACCA TCTCAAGAGATGATTCAAAAGACACCGTGTATCTGCTAATGAACAGCCTGAAAAC CGAGGACACAGCCGTGTATTACTGTACCATAGACCCCTCTACGATCTTTTGACT GGTCCCTGGGGCCAGGGACCCTGGTCACCGTCTCCTCA |
| 699 | KY10-$V_L$ | Amino acid sequence of KY10 light chain variable region | SYELTQPPSVSVSPGQTASITCSGDKLGDKYGCWYQQKPGQSPILVIYQDSKRPSG IPERFSGSNSGNTATLTISGTQAMDEADYYCQAWDSTVVFGGGTKLTVL |
| 700 | KY10-$V_L$ | Nucleic acid sequence of KY10 light chain variable region | TCCTATGAACTGACTCAGCCACCCTCAGTGTCCGTGTCCCCAGGACAGACAGCC AGCATCACCTGCTCTGGAGATAAATTGGGGATAATATGGTTGCTGGTATCAG CAGAAGCCAGGCCAGTCCCCTATACTGGTCATCTATCAAGATAGCAAGCGGCCC TCGGGGATCCCTGAGCGATTCTCTGGCTCCAATTCTGGGAACACAGCCACTCTG ACCATCAGCGGACCCAGGCTATGGATGAGGCTGACTATTACTGTCAGGCGTGG GACAGCAGCACTGTGGTTCGGCGGAGGGACCAAGCTGACCGTCCTA |
| 701 | KY11-$V_H$ | Amino acid sequence of KY11 heavy chain variable region | EVQLVESGGGLVKPGGSLRLSCAASGFTFSNAWMSWVRQAPGKGLEWVGRIKSKT NGGTTDYAAPVKGRFTISRDDSKNTLYLQMNSLKTEDTAVYYCTIDPLYDILTGPW GQGTLVTVSS |

-continued

SEQUENCE LISTING

| SEQ ID NO: | Name | Description | Sequence |
|---|---|---|---|
| 702 | KY11-$V_H$ | Nucleic acid sequence of KY11 heavy chain variable region | GAGGTCAGCTGGTGGAGTCTGGGGGAGGCTTGGTAAAGCCTGGGGGTCCCT TAGACTCTCCTGTGCAGCCTCTGGATTCACTTTTAGTAACCCTGATGAGCTG GGTCCGCCAGGCTCCAGGGAAGGGCTGGAGTGGGTTGGCCGTATTAAAAGCA AAACTAATGGTGGGACAACAGACTACGCTGCACCCGTGAAAGGCAGATTCACA TCTCAAGAGATGATTCAAAAAACACCTGTATCTGCAAATGAACAGCCTGAAAAC CGAGGACACAGCCGTGTATTACTGTGTACCATAGACACCCCTCTACGATATTTGACT GGTCCCTGGGCGCCAGGGACCCTGGTCACCGTCTCCTCA |
| 703 | KY11-$V_L$ | Amino acid sequence of KY11 light chain variable region | SYELTQPPSVSVSPGQTASITCSGDKLGDKYACWYQQKPGQSPVLVIYQDSKRPSG IPERFSGSNSGNTATLTISGTQAMDEADYYCQAWDSSTVVFGGGTKLTVL |
| 704 | KY11-$V_L$ | Nucleic acid sequence of KY11 light chain variable region | TCCTATGAGCTGACTCAGCCACCCTCAGTGTCCGTGTCCCAGGACAGACAGCC AGCATCACCTGCTCTGGAGATAAATTGGGGGATAAATATGCTTGCTGGTATCAG CAGAAGCCAGGCCAGTCCCGTGCTCATCTATCAAGATAGCAAGCGGCCC TCAGGGATCCCTGAGCGATTCTCTGGCTCCAATCTGGGAACACAGCCACTCTGA CCATCAGCGGGACCCAGGCTATGGATGAGGCTGACTATTACTGTCAGGCGTGG ACAGCACTGTGGTATTCCGCGGACCTGACCGTCCTA |
| 705 | KY12-$V_H$ | Amino acid sequence of KY12 heavy chain variable region | EVQLVESGGGLVKPGGSLRLSCAASGFTFSYAWMSWVRQAPGKGLEWVGRIKSKT NGGTTDVAAPVKGRFTISRDDSKNTLYLQMNSLKTEDTAVYYCTTDPLYDILTGLW GQGTLVTVSS |
| 706 | KY12-$V_H$ | Nucleic acid sequence of KY12 heavy chain variable region | GAGGTGCAGCTGGTGGAGTCTGGGGGAGGCTTGGTAAAGCCTGGGGGGTCCCT TAGACTCTCCTGTGCAGCCTCTGGATTCACTTTCAGTTACGCTTGGATGAGCTG GGTCCGCCAGGCTCCAGGGAAGGGGCTGGAGTGGGTTGGCCGTATCAAAAGCA AAACTAATGGTGGGACAACAGACTACGCTGCACCCGTGAAAGGCAGATTCACCA TCTCAAGAGATGATTCAAAAAACACCGTGTATCTGCAAATGAACAGCCTGAAAAC CGAGGACACAGCCGTGTATTACTGTACCACAGACCCCTCTACGATATTTGACT GGTCTATGGGGCCAGGGACCCTGGTCACCGTCTCCTCA |
| 707 | KY12-$V_L$ | Amino acid sequence of KY12 light chain variable region | SYELTQPPSMSVSPGQTASITCSGDKLGDKYACWYQQKPGQSPVLVIYQDSKRPS GIPERFSGSNSGNTATLTISGTQAMDESDYYCQAWDSSTVVFGGGTKLTVL |
| 708 | KY12-$V_L$ | Nucleic acid sequence of KY12 light chain variable region | TCCTATGAACTGACTCAGCCACCCTCAATGTCCGTGTCCCAGGACAGACAGCCA GCATCACCTGCTCTGGAGATAAATTGGGGGATAAATATGCTTGCTGGTATCAGC AGAAGCCAGGCCAGTCCCGTGCTCATCTATCAAGATAGCAAGCGCCCT CAGGGATCCCTGAGCGATTCTCTGGCTCCAACTCTGGAACACAGCCACTCTGA CCATCAGCGGGACCCAGGCTATGGATGAGTCTGACTATTACTGTCAGGCGTGGG ACAGCAGCTGGTATTCGGCGGAGGGACCAAACTGACCGTCCTA |
| 709 | KY13-$V_H$ | Amino acid sequence of KY13 heavy chain variable region | QVPLVESGGGLVRPGGSLRLSCAASGFTFSDYYMSWIRQAPGKGLEWVSYISSSGS TVYSADSVKGRFTVSRDNAKSSELHMNSLRAEDTAIYYCARDRGFGEESYCFDYW GQGTLVTVSS |
| 710 | KY13-$V_H$ | Nucleic acid sequence of KY13 heavy chain variable region | CAGGTGCCGCTGGTGGAGTCTGGGGGAGGCTTGGTCAGGCCTGGAGGGTCCT GAGACTCTCCTGTGCAGCCTCTGGATTCACCTTCAGTGACTACTACATGAGCTG GATCCCCCAGGCTCCAGGGAAGGGGCTGGAGTGGGTTTCATACATTAGTAGTA |

SEQUENCE LISTING -continued

| SEQ ID NO: | Name | Description | Sequence |
|---|---|---|---|
| | | | GTGGTAGTACCGTGTATTCCGAGACTCTGTGAAGGGCCGATTCACCGTCTCCA GGGACAACGCCAAGAGCTCACTGTCTTCTGCACATGAACAGCCTGAGAGCCGAGG ACACGGCCATATATTACTGTGCGAGAGATAGAGGGTTCGGGGAGTCCTATTGCT TTGACTACTGGGGCCAGGGAACCCTGGTCACCGTCTCCTCA |
| 711 | KY13-V$_L$ | Amino acid sequence of KY13 light chain variable region | DIQMTQSPSSLSASVGDRVTITCRASQNIKSYLTWYQQKPGKAPKLLIYTASSLQS GVPSRFSGSGSGTDFILTISSLQPEDFATYYCQQSYSIPCSFGQGTKLEIK |
| 712 | KY13-V$_L$ | Nucleic acid sequence of KY13 light chain variable region | GACATCCAGATGACCCAGTCTCCATCCTCCCTGTCTGCATCTGTAGGAGACAGA GTCACCATCACTTGCCGGGCCAGTCAGAACATTAAGAGTTATTTAACTTGGTATC AGCAGAAACCAGGGAAAGCCCCTAAGCTCCTGATCTATACTGCATCCAGTTTACA AAGTGGGGTCCCATCAAGGTTCAGTGGCAGTGGATCTGGGACAGATTTCACTCT CACCATCAGCAGTCTGCAACCTGAAGATTTTGCAACTTATTACTGTCAACAGAGT TACAGTATCCCGTGCAGTTTTGGCCAGGGGACCAAGCTGGAGATCAAA |
| 713 | KY14-V$_H$ | Amino acid sequence of KY14 heavy chain variable region | EVQLEESGGGLVKPGGSLRLSCAASGFTFSNAWMSWVRQAPGKGLEWVGRIKSKT NGGTTRDYAAPVKGRFTISRDDSKNTLYLQMNSLKTEDTAVYYCTIDPPLYDLLTGH WGQGTLVTVSS |
| 714 | KY14-V$_H$ | Nucleic acid sequence of KY14 heavy chain variable region | GAGGTGCAGCTGGAGGAGTCTGGGGGAGGCTTGGTAAAGCCGGGGGGTCCCT TAGACTCTCCTGTGCAGCCTCTGGATTCACTTTCAGTAACGCCTGATGAGCTG GGTCCGCCAGGCTCCAGGAAGGGGCTGGAGTGGGGTTGGCCGTATTAAAAGCA AAACTAATGGTGGACAAGAGACTATGCTGCACCCGTGAAAGGCAGATTCACCA TCTCAAGAGATGATTCAAAAAACACGCTGTATTACTGTACCACAGATCCCCCCTTTACGATCTTTTG CGAGGACACAGCCGTGTATTACTGTACCACAGATCCCCCCTTTACGATCTTTTG ACTGGCCATTGGGGCCAGGGAACCCTGGTCACCGTCTCCTCA |
| 715 | KY14-V$_L$ | Amino acid sequence of KY14 light chain variable region | SYELTQPPSVSVSPGQTASITCSGDKLGDKYACWYQQKPGQSPVLVIYQDSKRPSG IPERFSGSNSGNTALTISGTQAMDEADYYCQAWDSNTAVPFGAGTKVTVL |
| 716 | KY14-V$_L$ | Nucleic acid sequence of KY14 light chain variable region | TCCTATGAACTGACTCAGCCACCCTCAGTGTCCGTGTCCCAGGACAGAGCC AGCATCACCTGCTCTGGAGATAAATTGGGGGATAAATATGCTTGCTGGTATCAG CAGAAGCCAGGCCAGTCCCGTGCTGGTCATCTATCAAGATAGTAAGCGGCCC TCAGGGATCCCTGAGCGATTCTCTGGCTCCAACTCTGGGAACACAGCCACTCTG ACCATCAGCGGACCCCAGGCTATGAGGCTGACTATTACTGTCAGGCCTGG GACAGCAACACTGCTGTCTTCGGAGCTGGGACCAAGGTCACCGTCCTA |
| 717 | KY15-V$_H$ | Amino acid sequence of KY15 heavy chain variable region | EVQLVESGGGLVKPGGSLRLSCAASGFTFSNVWMSWVRQAPGKGLEWVGRIKSKS NGGTTDNSAPVKGRFTISRDDSKNTLYLQMNSLKTEDTAVYYCTTDPPLYDILTGH WGQGTLVTVSS |
| 718 | KY15-V$_H$ | Nucleic acid sequence of KY15 heavy chain variable region | GAGGTGCAGCTGGTGGAGTCTGGGGGAGGCTTGGTAAAGCCTGGGGGGTCCCT TAGACTCTCCTGTGCAGCCTCTGGATTCACTTTCAGTAACGTCTGATGAGCTG GGTCCGCCAGGCTCCAGGGAAGGGGCTGGAGTGGGTTGGCCGTATTAAAAGTA |

| SEQ ID NO: | Name | Description | Sequence |
|---|---|---|---|
| | | | AAAGTAATGGTGGACAACAGACAACTCTGCACCCTGAAAGGCAGATTCACCA TTTCAAGAGATGATTCAAAAAACACCGTGTATCTGCAAATGAACAGCCTGAAAAC CGAGGACACAGCCCTGTATTACTGTACCACAGATCCCCCCTTTACGATATTTTG ACTGGCCATTGGGGCCAGGGAACCCTGGTCATTGTCTCCTCA |
| 719 | KY15-$V_L$ | Amino acid sequence of KY15 light chain variable region | SYELTQPPSVSVSPGQTASITCSGDKLGDKYACWYQQKPGQSPVLVIYQDNKRPS GIPERFSGSNSGNTATLTISGTQAMDEADYYCQAWDSSTAVFGTGTKVIVL |
| 720 | KY15-$V_L$ | Nucleic acid sequence of KY15 light chain variable region | TCCTATGAATTGACTCAGCCACCCTCAGTGTCCGTGTCCCCAGGACAGACAGCC AGCATCACCTGCTCTGGAGATAAATTGGGGGATAAATATGCTTGCTGGTATCAG CAGAAGCCAGGCCAGTCCCGTGCTGGTCATCTATCAGGATAACAAGCGGCCC TCAGGGATCCCTGAGCGATTCTCTGGCTCCAACTCTGGGAACACAGCCACTCTG ACCATCAGCGGGACCCAGGCTATGGATGAGGCTGACTATTACTGTCAGGCGTGG GACAGCAGCACTGCTGTCTTCGGAACTGGGACCAAGGTCACCGTCCTA |
| 721 | KY16-$V_H$ | Amino acid sequence of KY16 heavy chain variable region | EVQLVESGGGLVQPGRSLRLSCAASGFTFDDYAMHVINRQTPGKGLEWVSGISWN SITIGYADSVKGRFTISRDNAKNSLYLQMNSLIAEDTALYYCAKDGGSLRYYGMDV WGQGTTVTVSS |
| 722 | KY16-$V_H$ | Nucleic acid sequence of KY16 heavy chain variable region | GAAGTCCAGTTGGTGGAGAGTGGGGGAGGCTTGGTACAGCCTGGCAGGTCCCT GAGACTCTCCTGTGCAGCCTCTGGATTCACCTTTGATGATTATGCCATGCACTG GGTCCGCCAAACTCCAGGGAAGGGCCTGGAGTGGTCTCAGGTATTAGTTGGA ATAGTATCACCATAGGCTATGCGGACTCTGTGAAGGGCCGATTCACCCTGTCCA GAGACAACGCCAAGAACTCCCTGTATCTGCAAAATGAACAGTCTGATAGCTGAGG ACACGGCCCTTGTATTATTACTGTGCAAAAGATGGTGGTCACTTCGCTACTACGGTA TGGACTTCTGGGGCCAAGGGACCACGGTCACCGTCTCCTCA |
| 723 | KY16-$V_L$ | Amino acid sequence of KY16 light chain variable region | DIVMTQSPLSLPVTPGEPASISCRSSQSLLHSNGYNYLNWYLQKAGQSPQLLIYLGS NRASGVPDRFSGSGSGTDFTLKISRVEAEDVGVFYCMQALQTPLTFGGGTKVEIK |
| 724 | KY16-$V_L$ | Nucleic acid sequence of KY16 light chain variable region | GATATTGTGATGACTCAGTCTCCACTCTCCCTGCCCGTCACCCCTGGAGAGCCG GCCTCCATCTCCTGCAGGTCTAGTCAGAGCCTCCTAGAGCATAGTAATGGATACAACT ATTTGAATTGGTACCTGCAGAAGCCAGGCCAGTCTCCACAGCTCCTGATCTATT TGGGTTCTAATCGGGCCTCCGGGGTCCCTGACAGGTTCAGTGGCAGTGGATCA GGCACAGATTTCACACTGAAAATCAGCAGAGTGGAGGCTGAGGATGTTGGGGTT TTTTACTGCATGCAAGCTCTACAAACTCCGCTCACTTTCGGCGGAGGGACTAAG GTGGAGATCAAA |
| 725 | KY17-$V_H$ | Amino acid sequence of KY17 heavy chain variable region | EVQLVESGGGLVQPGRSLRLSCTASGFSFDDYAMFMNRQVPGKGLEWVSGISWN SITIGYADSVKGRFTISRDNAKNSLYLQMNSLRAEDTALYFCAKDGGNRIMGMDV WGQGTTVTVSS |
| 726 | KY17-$V_H$ | Nucleic acid sequence of KY17 heavy chain variable region | GAAGTGCAGCTGGTGGAGTCTGGGGGAGGCTTGGTCCAGCCTGGCAGGTCCCT GAGACTCTCCTGTACAGCCTCTGGATTCTCCTTTGATTATGCCATGCACTGGAA GTCCGCAAGTTCCAGGGAAGGGCCTGGAGTGGTCTCAGGTATTAGTTGGAA TAGTATTACCATTGGCTATGCGGACTCTGTGAAGGGCCGATTCACCATCTCCAG |

SEQUENCE LISTING

| SEQ ID NO: | Name | Description | Sequence |
|---|---|---|---|
| | | | AGACAACGCCAAGAACTCCCTCTATCTGCAAATGACAGTCTGAGAGCTGAGGA CACGGCCTTGTATTCTGTGCAAAAGATGGGGGAATAGGAAATACTATGGTAT GGACGTCTGGGGCCAAGGGACCACGGTCACCGTCTCCTCA |
| 727 | KY17-V$_L$ | Amino acid sequence of KY17 light chain variable region | DIVMTQSPLSLPVTPGEPASISCRSSQSLLHSNGYNYLDWYLQKPGQSPHLLIYLGS NRASGVPDRFSGSGSGTDFTLKISRVEAADVGVYFCLQALQTPCSSFGQGTKLEIK |
| 728 | KY17-V$_L$ | Nucleic acid sequence of KY17 light chain variable region | GATATTGTGATGACTCAGTCTCCACTCTCCCTGCCCGTCACCCCTGGAGAGCCG GCCTCCATCTCCTGCAGGTCTAGTCAGAGCCTCCTGCATAGTAATGGATACAACT ATTTGGATTGGTACCTGCAGAAGCCAGGGCAGTCTCCACACCTCCTGATCTATT TGGGTTCTAATGGGCCTCCGGGGTCCCTGACAGGTTCAGTGGCAGTGGATCA GGCACAGATTTTACACTGCAAGCTGAAAATCAGGAGAGTGGAGGCTGACGATGTTGGGGTT TATTTCTGCTTGCAAGCTCTACAAACTCCGTGCAGTTTTGGCCAGGGGACCAAG CTGGAGATCAAA |
| 729 | KY18-V$_H$ | Amino acid sequence of KY18 heavy chain variable region | EVQLVESGGGLVQPGRSLRLSCAASGFTFDDYAMHWVRQAPGKGLEWVSGISWN SITIGYADSVKGRFTISRDNAKNSLYLQMNSLRAEDTALYYCTKDGGNRRYYGVDV WGQGTTVTVSS |
| 730 | KY18-V$_H$ | Nucleic acid sequence of KY18 heavy chain variable region | GAAGTCCAGCTGGTGGAGTCTGGGGGAGGCTTGGTACAGCCTGGCAGGTCCCT GAGACTCTCCTGTGCAGCCTCTGGATTCACCTTTGATGATTATGCCATGCACTG GGTCCGCCAAGCTCCAGGGAAGGGCCTGGAGTGGGTCTCAGGTATTAGTTGGA ATAGTATTACCATAGGCTATGCGGACTCTGTGAAGGGCCGATTCACCATCTCCA GAGACAACGCCAAGAACTCCCTCTATCTGCAAATGAACAGTCTGAGAGCTGAGG ACACGGCCCTTGTATTACTGTACAAAAGATGGGGGAATAGGAGAGATACTACGGTG TGGACGTCTGGGGCCAAGGGACCACGGTCACCAGTCTCCTCA |
| 731 | KY18-V$_L$ | Amino acid sequence of KY18 light chain variable region | DIVMTQSPLSLPVTPGEPASISCRSSQSLLHSNGYNYLDWYLQKPGQSPQLLIYLGS NRASGVPDRFSGSGSGTDFTLKISRVEAEDVGWYCMQALQTPCSFGQGTKLEIK |
| 732 | KY18-V$_L$ | Nucleic acid sequence of KY18 light chain variable region | GATATTGTGATGACTCAGTCTCCACTCTCCCTGCCCGTCACCCTGGAGAGCCG GCCTCCATCTCCTGCAGGTCTAGTCAGAGCCTCCTGCATAGTAATGGATACAACT ATTTGGATTGGTACCTGCAGAAGCCAGGGCAGTCTCCACAGCTCCTGATCTATT TGGGTTCTAATGCGGCCTCCGGGGTCCCTGACAGGTTCAGTGGCAGTGGATCA GGCACAGATTTTACACTGCAAAATCAGCAGAGTGGAGGCTGAGGATGTTGGGGTT TATTACTGCATGCAAGCTCTACAAACTCCGTGCAGTTTTGGCCAGGGGACCAAG CTGGAGATCAAA |
| 733 | KY19-V$_H$ | Amino acid sequence of KY19 heavy chain variable region | EVQLVESGGGLVQPGRSLRLSCAASGFTFDDYAMHWVRQAPGKGLEWVSGISWN SINIGYADSVKGRFTISRDNAKNSLYLQMNSLRAEDTALYYCAKDIPVKSYNGLDV WGQGTTVTVSS |
| 734 | KY19-V$_H$ | Nucleic acid sequence of KY19 heavy chain variable region | GAAGTCCAGCTGGTGGAGTCTGGGGGAGGCTTGGTACAGCCTGGCAGGTCCCT GAGACTCTCCTGTGCAGCCTCTGGATTCACCTTTGACGATTATGCCATGCACTG GGTCCGGCAAGCTCCAGGGAAGGGCCTGGAGTGGGTCTCAGGTATTAGCTGGA ATAGTATTAACATAGGCTATGCGGACTCTGTGAAGGGCCGATTCACCATCTCCA |

| SEQ ID NO: | Name | Description | Sequence |
|---|---|---|---|
| 735 | KY19-V_L | Amino acid sequence of KY19 light chain variable region | GAGACAACGCCAAGAACTCCCTGTATCTGCAAATGAACAGTCTGAGAGCTGAGG ACACGGCCTTGTATTACTGTGCAAAAGACATCCCGGTGAAGTCCTACAACGTT TGGACTGTCGGGCCAAGGGACCACGGTCACCGTCCTCCTCA |
| 736 | KY19-V_L | Nucleic acid sequence of KY19 light chain variable region | DIVMTQSPLSLPVTPGEPASISCRSSQSLIHSNGYNYLDWYLQKPGQSPQLLIYLGS NRASGVPDRFSGSGSGTDFTLKISRVEAEDVGVYYCMQALQTPLTFGGGTKVEIK |
| 737 | KY20-V_H | Amino acid sequence of KY20 heavy chain variable region | GATATTGTGATGACTCAGTCTCCACTCTCCCTGCCCGTCACCCCTGGAGAGCCG GCCTCCATCTCCTGCAGGTCTAGTCAGAGCCTCCTGCATAGTAATGGATACAACT ATTTGGATTGGTACCTGCAGAAGCCAGGCCAGTCTCCACAGCTCCTGATCTATT TGGGTTCTAATCGGGCCTCCGGGGTCCCTGACAGGTTCAGTGGCAGTGGATCA GGCACAGATTTTACACTGAAAATCAGCAGAGTGGAGGCTGAGGATGTTGGGGTT TATTACTGCATGCAAGCTCTACAAACTCCGCTCACTTTCGGCGGAGGGACCAAG GTGGAGATCAAA |
| 738 | KY20-V_H | Nucleic acid sequence of KY20 heavy chain variable region | EVQLVESGGGLVQPGGSLRLSCAASGFTFDDYGMYWVRQVPGKGLEWVSGISWN SISIGYADSVKGRFTISRDNAKNSLYLDMNTLRAEDTAMYYCAKDGGLKYYYGMDV WGQGTTVTVSS |
| 739 | KY20-V_L | Amino acid sequence of KY20 light chain variable region | GAAGTGCAGTTGGTGGAGTCTGGGGGAGGCTTGGTACAGCCTGGCGGGTCCCT GAGACTCTCCTGTGCAGCCTCTGGATTCACCTTTGACGATTATGGCATGTACTG GGTCCGCCAAGTTCCAGGGAAGGGCCTGGAGTGGGTCTCAGGAATTAGTTGGA ATAGTATTAGTATAGGCTATGCGGACAGTGTGAAGGGCCGATTCACCATCTCCA GAGACAACGCCAAGAATTCCCTGTATCTGGACATGAACACTCTGAGAGCTGAGG ACACGGCCATGTATTACTGTGCAAAAGATGGTGGCTTGAAATACTACTACGGTA TGGACGTCTGGGGCCAAGGGACCACGGTCACCGTCTCCTCA |
| 740 | KY20-V_L | Nucleic acid sequence of KY20 light chain variable region | DIVMTQSPLSLPVTPGEPASISCRSSQSLIHSNGYIYLAWYLHKPGQSPHLLIYLGS NRASGVPDRFSGSGSGSTDFTLKISRVESEDVGIYYCMQALQTPLIFGGGTINEIK |
| 741 | KY21-V_H | Amino acid sequence of KY21 heavy chain variable region | GATATTGTGATGACTCAGTCTCCACTCTCCCTGCCCGTCACCCCTGGAGAGCCG GCCTCCATCTCCTGCAGGTCTAGTCAGAGCCTCCTGCATAGTAATGGATACATCT ATCTGGCTTGGTACCTGCATAAGCCAGGACAGTCTCCACATCTCCTGATCTATTT GGGTTCTAATCGGGCCTCCGGGGTCCCTGACAGGTTCAGTGGCAGTGGATCAA GCACAGATTTTACACTGAAAATCAGCAGAGTCGAGAGTGACTCGGGGATTT ATTACTGCATGCAAGCTCTACAAACTCCGCTCACTTTCGGCGGAGGGACCAAGG TGGAGATCAAA |
| 742 | KY21-V_H | Nucleic acid sequence of KY21 heavy chain variable region | QVQLVESGGGLVKPGGSLRLSCAASGFIFSDYMSWIRQAPGKGLEWISYSSSSGP TIYFADSVKGRFTISRDNAKKSLYLQMNSLRDEDTAVYYCAREGITMGRWGMDVW GQGTMTVSS |
| | | | CAGGTGCAGTTGGTGGAGTCTGGGGGAGGCTTGGTCAAGCCTGGAGGGTCCCT GAGACTCTCCTGTGCAGCCTCTGGATTCATCTTCAGTGACTACATGAGTTG GATCCGCCAGGCTCCAGGGAAGGGGCTGGAGTGGATTTCATATAGTAGTAGTA GTGGTCCTACCATATACTTCGCAGACTCTGTGAAGGGCCGATTCACCATCTCCA |

| SEQ ID NO: | Name | Description | Sequence |
|---|---|---|---|
| | | | GGGACAATGCCAAGAGTCATTGTATCTGCAAATGAACAGCCTGAGAGACGAGG<br>ACACGGCCGTATATTATTGTGCGAGAGAGGGTATCACTATGGGCCCGTGGGGT<br>ATGGACGTCTGGGGCCAAGGGACCATGGTCACCGTCTCATCA |
| 743 | KY21-V$_L$ | Amino acid sequence of KY21 light chain variable region | DMQMTQSPSTLSASVGDRVTITCRASQSISNWLAWYQQKPGKAPKLLIYKASNLE<br>SGVSSRFSGSGSGTEFTLTISSLQPDDVATYHCQQYNSYTFGGGTKVEIK |
| 744 | KY21-V$_L$ | Nucleic acid sequence of KY21 light chain variable region | GACATGCAGATGACCCAGTCTCCTTCCACCCTGTCTGCATCTGTAGGAGACAGA<br>GTCACCATCACTTGCCGGGCCAGTCAGAGTATCAGTAACTGGTTGCCTGGTAT<br>CAGCAGAAACCAGGGAAAGCCCCTAAACTCCTGATCTATAAGGCGTCTAATTTA<br>GAAAGTGGGGTCTCATCAAGGTTCAGCGGCAGTGGATCTGGGACAGAATTCACT<br>CTCACCATCAGCAGCCTGCAGCCTGATGATGTTGCAACTTATCACTGCCAACAGT<br>ATAATAGTTATACTTTCGGCGGAGGGACCAAGGTGGAGATCAAA |
| 745 | KY22-V$_H$ | Amino acid sequence of KY22 heavy chain variable region | EVQLVESGGSVVRPGGSLRLSCAASGFSFDASGMSWIRQAPGKGLEWVSGINYIG<br>GSTGYADSVKGRFTISRDNAKNSLYLQMNSLRADDTALYYCAREVYSSTWDDYW<br>GQGTLVTVSS |
| 746 | KY22-V$_H$ | Nucleic acid sequence of KY22 heavy chain variable region | GAGGTGCAGCTGGTGGAGTCTGGGGGAAGTGTTACGGCCGGGGGGTCCCT<br>GAGACTCTCCTGTGCAGCCTCTGGATTCTCCTTTGATGCTTCTGGCATGAGCTG<br>GATCCGCCAAGCTCCAGGTTATGCAGAAGGGCCTGGAGTGGGTCTCTGTATTAATTACAT<br>TGGTGGTAGCACAGGTTATGCAGATCTGTGAAGGCCGATTCACCATCTCCAG<br>AGACAACGCCAAGAACTCCCTGTATCTCAAATGAACAGTCTGAGAGCCGACGA<br>CACGGCCTTGTATTACTGTGCGCGAGAGGTTTATAGCAGCACCTGGTACGATGA<br>CTACTGGGGCCAGGGAACCCTGGTCACCGTCTCCTCA |
| 747 | KY22-V$_L$ | Amino acid sequence of KY22 light chain variable region | DIQMTQSPSSLSTSVGDRVTITCRASQSINTYLNWYQQKSGKAPKLLIYAASSLRS<br>GVPSRFSGSGSGTDFTLTINNLQPEDFATYYCQQSYRTPLIFGGGAKVEIK |
| 748 | KY22-V$_L$ | Nucleic acid sequence of KY22 light chain variable region | GACATCCAGATGACCCAGTCTCCTTCCTCCCTGTCTACATCTGTAGGAGACAGA<br>GTCACCATCACTTGCCGGGCAAGTCAGAGCATTAACACCTATTTAAATTGGTATC<br>AGCAGAAATCAGGGAAAGCCCTAAACTCCTGATCTATGCTGCATCCAGTTTGC<br>GAAGTGGGGTTCCATCAAGGTTCAGTGGCAGTGGATCGGGACAGATTTCACTC |

| SEQ ID NO: | Name | Description | Sequence |
|---|---|---|---|
| | | | TCACCATCAACAATCTACAACCTGAAGATTTTGCAACTTACTACTGTCAACAGAG TTACAGGACCCCGCTCACTTTCGGCGGAGGGACCAAGGTGGAGATCAAA |
| 749 | KY23-V$_H$ | Amino acid sequence of KY23 heavy chain variable region | EVQLVESGGGLVQPGRSLRLSCAASGFTFDDYAMHWVRQVPGKGLEWVSGISWN SITIGYAGSVKGRFTISRDNAKNSLYLQMNSLRVEDTALYYCSKDIGVMKYFGLDV WGQGTMVTVSS |
| 750 | KY23-V$_H$ | Nucleic acid sequence of KY23 heavy chain variable region | GAAGTGCAACTGGTGGAGTCTGGGGGAGGCTTGGTACAGCCTGGCAGGTCCCT GAGACTCTCCTGTGCAGCCTCTGGATTCACCTTTGATGATTATGCCATGCACTG GGTCCGCCAAGTTCCAGGGAAGGGCCTGGAGTGGGTCTCAGGTATTAGTTGGA ATAGTATTACCATAGGCTATGCGGGCTCTGTGAAGGGCCGATTCACCATCTCCA GAGACAACGCCAAAAACTCCCTGTATCTACAAATGAACAGTCTGAGAGTTGAGG ACACGGCCTTATATTACTGTTCAAAAGATATAGGAGTCATGAAGTACTTCGGTTT GGACGTCTGGGGCCAAGGGACCATGGTCACCGTCTCCTCA |
| 751 | KY23-V$_L$ | Amino acid sequence of KY23 light chain variable region | DIVMTQSPLSLPVTPGEPASISCRSSQSLLHSNGYNYLDWYLQKPGQSPQLLIHLGS IRASGVPDRFSGSGSGTDFTLKISRVEAEDVGVYNCMQALQTPLTFGGGTKVEIK |
| 752 | KY23-V$_L$ | Nucleic acid sequence of KY23 light chain variable region | GATATTGTGATGACTCAGTCTCCGCTCTCCCTGCCCGTCACCCCTGGAGAGCCG GCCTCCATCTCCTGCAGGTCTAGTCAGAGCCTCCTGCATAGTAATGGATACAACT ATTTGGATTGGTACCTGCAGAAGCCAGGGCAGTCTCCACAACTCCTGATCCATC TGGGTTCTATTCGGGCCTCCGGGGTCCCTGACAGGTTCAGTGGCAGTGGATCA GGCACAGATTTTACACTGAAAATCAGTAGAGTGGAGGCTGAGGATGTTGGGGTT TATAACTGCATGCAAGCTCTACAAACTCCGCTCACTTTCGGCGGAGGGACCAAG GTGGAGATCAAA |

SEQUENCE LISTING (753 sequences)

SEQ ID NO: 1 - protein, 290 aa, Homo Sapien
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 2 - protein, 241 aa, Cynomologus
MGWSCIILFLVATATGVHSMFTVTVPKDLYVVEYGSNMTIECKFPVEKQLDLTSLIVYWEMEDKNIIQFVHGEEDLKVQHSNYRQRAQLLKDQLSLGNAALRITDVKLQDAGVYRCMISYGGADYKRITVKVNAPYNKINQRILVVDPVTSEHELTCQAEGYPKAEVIWTSSDHQVLSGKTTTTNSKREEKLLNVTSTLRINTTANEIFYCIFRRLDPEENHTAELVIPELPLALPPNERT

SEQ ID NO: 3 - protein, 245 aa, Homo Sapien
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHHHHHH

SEQ ID NO: 4 - protein, 475 aa, Homo Sapien
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTIEGREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5 - protein, 249 aa, Cynomologus
MGWSCIILFLVATATGVHSMFTVTVPKDLYVVEYGSNMTIECKFPVEKQLDLTSLIVYWEMEDKNIIQFVHGEEDLKVQHSNYRQRAQLLKDQLSLGNAALRITDVKLQDAGVYRCMISYGGADYKRITVKVNAPYNKINQRILVVDPVTSEHELTCQAEGYPKAEVIWTSSDHQVLSGKTTTTNSKREEKLLNVTSTLRINTTANEIFYCIFRRLDPEENHTAELVIPELPLALPPNERTDYKDDDDK

SEQ ID NO: 6 - protein, 405 aa, Homo Sapien
MGWSCIILFLVATATGVHSLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQKLENLYFQGIEGRMDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 7 - protein, 8 aa, Homo Sapien
GFTFDDYA

SEQ ID NO: 8 - protein, 8 aa, Homo Sapien
ISWKSNII

SEQ ID NO: 9 - protein, 15 aa, Homo Sapien
ARDITGSGSYGWFDP

SEQ ID NO: 10 - protein, 5 aa, Homo Sapien
DYAMH

SEQ ID NO: 11 - protein, 17 aa, Homo Sapien
GISWKSNIIGYADSVKG

SEQ ID NO: 12 - protein, 13 aa, Homo Sapien
DITGSGSYGWFDP

SEQ ID NO: 13 - protein, 122 aa, Homo Sapien
EVQLVESGGGLVQPGRSLRLSCAASGFTFDDYAMHWVRQTPGKGLEWVSGISWKSNIIGYADSVKGRFTISRDNAKNSLYLQMNSLRAEDTALYYCARDITGSGSYGWFDPWGQGTLVTVSS

SEQ ID NO: 14 - DNA, 508 bp, Homo Sapien
caagaaaaagcttgccgccaccatggagtttgggctgagctggattttccttttggctattttaaaaggtgtccagtgtgaagtacaattggtggagtccgggggaggcttggtacagcctggcaggtccctgagactctcctgtgcagcctctggattcacctttgatgattatgccatgcactgggtccgacaaactccagggaagggcctggagtgggtctcaggtataagttggaagagtaatatcataggctatgcggactctgtgaagggccgattcaccatctccagagacaacgccaagaactccctgtatctgcaaatgaacagtctgagagctgaggacacggccttgtattattgtgcaagagatataacgggttcggggagttatggctggttcgacccctggggccagggaaccctggtcaccgtctcctcagccaaaacgacacccccatctgtctatccactggcccctgaatctgctaaaactcagcctccg

SEQ ID NO: 15 - protein, 449 aa, Homo Sapien
EVQLVESGGGLVQPGRSLRLSCAASGFTFDDYAMHWVRQTPGKGLEWVSGISWKSNIIGYADSVKGRFTISRDNAKNSLYLQMNSLRAEDTALYYCARDITGSGSYGWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 16 - DNA, 1356 bp, Homo Sapien
gaagtgcagctggtggaatctggcggcggactggtgcagcctggcagatccctgagactgtcttgtgccgcctccggcttcaccttcgacgactacgctatgcactgggtgcgacagacccctggcaagggcctggaatgggtgtccggcatctcctggaagtccaacatcatcggctacgccgactccgtgaagggccggttcaccatctcccgggacaacgccaagaactccctgtacctgcagatgaacagcctgcgggccgaggacaccgccctgtactactgcgccagagacatcaccggctccggctcctacggatggttcgatccttggggccagggcaccctcgtgaccgtgtcctctgccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 17 - protein, 6 aa, Homo Sapien
QSISSY

SEQ ID NO: 18 - protein, 3 aa, Homo Sapien
VAS

SEQ ID NO: 19 - protein, 9 aa, Homo Sapien
QQSYSNPIT

SEQ ID NO: 20 - protein, 11 aa, Homo Sapien
RASQSISSYLN

SEQ ID NO: 21 - protein, 7 aa, Homo Sapien
VASSLQS

SEQ ID NO: 22 - protein, 9 aa, Homo Sapien
QQSYSNPIT

SEQ ID NO: 23 - protein, 107 aa, Homo Sapien
DIQMTQSPSSLSASVGDRVTITCRASQSISSYLNWYQQKPGKAPKPLIYVASSLQSGVPSSFSGSGSGTDFTLTISSLQPEDFATYYCQQSYSNPITFGQGTRLEIK

SEQ ID NO: 24 - DNA, 321 bp, Homo Sapien
gacatccagatgacccagtctccatcctccctgtctgcatctgtaggagacagagtcaccatcacttgccgggcaagtcagagcattagcagctatttaaattggtatcagcagaaaccagggaaagcccctaagcccctgatctatgttgcatccagtttgcaaagtggggtcccatcaagtttcagtggcagtggatctgggacagatttcactctcaccatcagcagtctgcaacctgaagattttgcaacttactactgtcaacagagttacagtaatccgatcaccttcggccaagggacacgactggagatcaaa

SEQ ID NO: 25 - protein, 214 aa, Homo Sapien
DIQMTQSPSSLSASVGDRVTITCRASQSISSYLNWYQQKPGKAPKPLIYVASSLQSGVPSSFSGSGSGTDFTLTISSLQPEDFATYYCQQSYSNPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26 - DNA, 642 bp, Homo Sapien
gacatccagatgacccagtctccatcctccctgtctgcatctgtaggagacagagtcaccatcacttgccgggcaagtcagagcattagcagctatttaaattggtatcagcagaaaccagggaaagcccctaagcccctgatctatgttgcatccagtttgcaaagtggggtcccatcaagtttcagtggcagtggatctgggacagatttcactctcaccatcagcagtctgcaacctgaagattttgcaacttactactgtcaacagagttacagtaatccgatcaccttcggccaagggacacgactggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 27 - protein, 8 aa, Homo Sapien
GFTFDDYA

SEQ ID NO: 28 - protein, 8 aa, Homo Sapien
ISWIRTGI

SEQ ID NO: 29 - protein, 16 aa, Homo Sapien
AKDMKGSGTYGGWFDT

SEQ ID NO: 30 - protein, 5 aa, Homo Sapien
DYAMH

SEQ ID NO: 31 - protein, 17 aa, Homo Sapien
GISWIRTGIGYADSVKG

SEQ ID NO: 32 - protein, 14 aa, Homo Sapien
DMKGSGTYGGWFDT

SEQ ID NO: 33 - protein, 123 aa, Homo Sapien
EVQLVESGGGLVQPGRSLRLSCAASGFTFDDYAMHWVRQVPGKGLEWVSGISWIRTGIGYADSVKGRFTIFRDNAKNSLYLQMNSLRAEDTALYYCAKDMKGSGTYGGWFDTWGQGTLVTVSS

SEQ ID NO: 34 - DNA, 482 bp, Homo Sapien
aagcttgccgccaccatggagtttgggctgagctggattttccttttggctattttaaaaggtgtccagtgtgaagtgcagctggtggagtctgggggaggcttggtgcagcctggcaggtccctgagactctcctgtgcagcctctggattcacctttgatgattatgccatgcactgggtccggcaagttccagggaagggcctggaatgggtctcaggcattagttggattcgtactggcataggctatgcggactctgtgaagggccgattcaccattttcagagacaacgccaagaattccctgtatctgcaaatgaacagtctgagagctgaggacacggccttgtattactgtgcaaaagatatgaagggttcggggacttatggggggtggttcgacacctggggccagggaaccctggtcaccgtctcctcagccaaaacaacagccccatcggtctatccactggcccctgc

SEQ ID NO: 35 - protein, 450 aa, Homo Sapien
EVQLVESGGGLVQPGRSLRLSCAASGFTFDDYAMHWVRQVPGKGLEWVSGISWIRTGIGYADSVKGRFTIFRDNAKNSLYLQMNSLRAEDTALYYCAKDMKGSGTYGGWFDTWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 36 - DNA, 1359 bp, Homo Sapien
gaagtgcagctggtggaatctggcggcggactggtgcagcctggcagatccctgagactgtcttgtgccgcctccggcttcaccttcgacgactacgctatgcactgggtgcgacaggtgccaggcaagggcctggaatgggtgtccggcatctcttggatccggaccggcatcggctacgccgactctgtgaagggccggttcaccatcttccgggacaacgccaagaactccctgtacctgcagatgaacagcctgcgggccgaggacaccgccctgtactactgcgccaaggacatgaagggctccggcacctacggcggatggttcgatacttggggccagggcaccctcgtgaccgtgtcctctgccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 37 - protein, 6 aa, Homo Sapien
QSISSY

SEQ ID NO: 38 - protein, 3 aa, Homo Sapien
VAS

SEQ ID NO: 39 - protein, 9 aa, Homo Sapien
QQSYSTPIT

SEQ ID NO: 40 - protein, 11 aa, Homo Sapien
RASQSISSYLN

SEQ ID NO: 41 - protein, 7 aa, Homo Sapien
VASSLQS

SEQ ID NO: 42 - protein, 9 aa, Homo Sapien
QQSYSTPIT

SEQ ID NO: 43 - protein, 107 aa, Homo Sapien
DIQMTQSPSSLSASVGDRVTITCRASQSISSYLNWYQQKPGKAPKLLIYVASSLQSGVPSRFSGSGSGTDFTLTISSLQPEDFATYYCQQSYSTPITFGQGTRLEIK

SEQ ID NO: 44 - DNA, 418 bp, Homo Sapien
aaagcttgccgccaccatgaggctccctgctcagcttctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgttgcatccagtttgcaaagtggggtcccatcaaggttcagtggcagtggatctgggacagatttcactctcactatcagcagtctgcaacctgaagattttgcaacttactactgtcaacagagttacagtaccccgatcaccttcggccaagggacacgtctggagatcaaacgtacggatgctgcaccaact

SEQ ID NO: 45 - protein, 214 aa, Homo Sapien
DIQMTQSPSSLSASVGDRVTITCRASQSISSYLNWYQQKPGKAPKLLIYVASSLQSGVPSRFSGSGSGTDFTLTISSLQPEDFATYYCQQSYSTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 46 - DNA, 642 bp, Homo Sapien
gacatccagatgacccagtccccctccagcctgtctgcttccgtgggcgacagagtgaccatcacctgtcgggcctcccagtccatctcctcctacctgaactggtatcagcagaagcccggcaaggcccccaagctgctgatctacgtggccagctctctgcagtccggcgtgccctctagattctccggctctggctctggcaccgactttaccctgaccatcagctccctgcagcccgaggacttcgccacctactactgccagcagtcctactccacccctatcaccttcggccagggcacccggctggaaatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 47 - protein, 450 aa, Homo Sapien
EVQLVESGGGLVQPGRSLRLSCAASGFTFDDYAMHWVRQAPGKGLEWVSGISWIRTGIGYADSVKGRFTIFRDNAKNSLYLQMNSLRAEDTALYYCAKDMKGSGTYGGWFDTWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPELAGAPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 48 - protein, 450 aa, Homo Sapien
EVQLVESGGGLVQPGRSLRLSCAASGFTFDDYAMHWVRQVPGKGLEWVSGISWIRTGIGYADSVKGRFTISRDNAKNSLYLQMNSLRAEDTALYYCAKDMKGSGTYGGWFDTWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPELAGAPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 49 - protein, 448 aa, Homo Sapien
EVQLVESGGGLVQPGRSLRLSCAASGFTFDDYAMHWVRQVPGKGLEWVSGISWIRTGIGYADSVKGRFTIFRDNAKNSLYLQMNSLRAEDTALYYCAKDMKGSGTYGGWFDTWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 50 - protein, 214 aa, Homo Sapien
DIQMTQSPSSLSASVGDRVTITCRASQSISSYLNWYQQKPGKAPKLLIYAASSLQSGVPSRFSGSGSGTDFTLTISSLQPEDFATYYCQQSYSTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 51 - protein, 214 aa, Homo Sapien
DIQMTQSPSSLSASVGDRVTITCRASQSISSYLNWYQQKPGKAPKLFIYVASSLQSGVPSRFSGSGSGTDFTLTISSLQPEDFATYYCQQSYSTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 52 - protein, 8 aa, Homo Sapien
GFTFSSYW

SEQ ID NO: 53 - protein, 8 aa, Homo Sapien
IKEDGSEK

SEQ ID NO: 54 - protein, 12 aa, Homo Sapien
ARNRLYSDFLDN

SEQ ID NO: 55 - protein, 5 aa, Homo Sapien
SYWMS

SEQ ID NO: 56 - protein, 17 aa, Homo Sapien
NIKEDGSEKYYVDSVKG

SEQ ID NO: 57 - protein, 10 aa, Homo Sapien
NRLYSDFLDN

SEQ ID NO: 58 - protein, 119 aa, Homo Sapien
EVQLVESGGGLVQPGGSLRLSCAASGFTFSSYWMSWVRQAPGKGLEWVANIKEDGSEKYYVDSVKGRFTISRDNAKNSLYLQMNSLRAEDTSVYYCARNRLYSDFLDNWGQGTLVTVSS

SEQ ID NO: 59 - DNA, 358 bp, Homo Sapien
gaggtgcagctggtggagtctgggggaggcttggtccagcctggggggtccctgagactctcctgtgcagcctctggattcacgtttagtagctattggatgagttgggtccgccaggctccagggaaggggctggagtgggtggccaacatcaaagaagatggaagtgagaaatactatgtcgactctgtgaagggccgattcaccatctccagagacaacgccaagaactcactgtatctgcaaatgaacagcctgagagccgaggacacgtctgtgtattactgtgcgagaaatcgactctacagtgacttccttgacaactggggccagggaaccctggtcaccgtctcctcag

SEQ ID NO: 60 - protein, 449 aa, Homo Sapien
EVQLVESGGGLVQPGGSLRLSCAASGFTFSSYWMSWVRQAPGKGLEWVANIKEDGSEKYYVDSVKGRFTISRDNAKNSLYLQMNSLRAEDTSVYYCARNRLYSDFLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61 - DNA, 1347 bp, Homo Sapien
gaggtgcagctggtggagtctgggggaggcttggtccagcctggggggtccctgagactctcctgtgcagcctctggattcacgtttagtagctattggatgagttgggtccgccaggctccagggaaggggctggagtgggtggccaacatcaaagaagatggaagtgagaaatactatgtcgactctgtgaagggccgattcaccatctccagagacaacgccaagaactcactgtatctgcaaatgaacagcctgagagccgaggacacgtctgtgtattactgtgcgagaaatcgactctacagtgacttccttgacaactggggccagggaaccctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 62 - protein, 6 aa, Homo Sapien
QGVSSW

SEQ ID NO: 63 - protein, 3 aa, Homo Sapien
GAS

SEQ ID NO: 64 - protein, 9 aa, Homo Sapien
QQANSIPFT

SEQ ID NO: 65 - protein, 11 aa, Homo Sapien
RASQGVSSWLA

SEQ ID NO: 66 - protein, 7 aa, Homo Sapien
GASSLQS

SEQ ID NO: 67 - protein, 9 aa, Homo Sapien
QQANSIPFT

SEQ ID NO: 68 - protein, 107 aa, Homo Sapien
DIQMTQSPSSVSASVGDRVTITCRASQGVSSWLAWYQQKSGKAPKLLIYGASSLQSGVPSRFSGSGSGTEFILTISSLQPEDFATYYCQQANSIPFTFGPGTKVDIK

SEQ ID NO: 69 - DNA, 322 bp, Homo Sapien
gacatccagatgacccagtctccatcttccgtgtctgcatctgtcggagacagagtcaccatcacttgtcgggcgagtcagggtgttagcagctggttagcctggtatcagcagaaatcagggaaagcccctaagctcctgatctatggtgcatccagtttgcaaagtggggtcccatcaagattcagcggcagtggatctgggacagagttcattctcaccatcagcagcctgcagcctgaagattttgcaacttactattgtcaacaggctaacagtatcccattcactttcggccctgggaccaaagtggatatcaaac

SEQ ID NO: 70 - protein, 214 aa, Homo Sapien
DIQMTQSPSSVSASVGDRVTITCRASQGVSSWLAWYQQKSGKAPKLLIYGASSLQSGVPSRFSGSGSGTEFILTISSLQPEDFATYYCQQANSIPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 71 - DNA, 642 bp, Homo Sapien
gacatccagatgacccagtctccatcttccgtgtctgcatctgtcggagacagagtcaccatcacttgtcgggcgagtcagggtgttagcagctggttagcctggtatcagcagaaatcagggaaagcccctaagctcctgatctatggtgcatccagtttgcaaagtggggtcccatcaagattcagcggcagtggatctgggacagagttcattctcaccatcagcagcctgcagcctgaagattttgcaacttactattgtcaacaggctaacagtatcccattcactttcggccctgggaccaaagtggatatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 72 - protein, 8 aa, Homo Sapien
GFTFSSYW

SEQ ID NO: 73 - protein, 8 aa, Homo Sapien
IKEDGSEK

SEQ ID NO: 74 - protein, 12 aa, Homo Sapien
ARVRLYSDFLDY

SEQ ID NO: 75 - protein, 5 aa, Homo Sapien
SYWMS

SEQ ID NO: 76 - protein, 17 aa, Homo Sapien
NIKEDGSEKYYVDSLKG

SEQ ID NO: 77 - protein, 10 aa, Homo Sapien
VRLYSDFLDY

SEQ ID NO: 78 - protein, 119 aa, Homo Sapien
EVQLVDSGGGLVQPGGSLRLSCAASGFTFSSYWMSWVRQAPGKGLEWVANIKEDGSEKYYVDSLKGRFTISRDNAKNSLYLQMNSLRAEDTSVYYCARVRLYSDFLDYWGQGTLVTVSS

SEQ ID NO: 79 - DNA, 358 bp, Homo Sapien
gaggtgcagctggtggactctgggggaggcttggtccagcctggggggtccctgagactctcctgtgcagcctctggattcacgtttagtagctattggatgagttgggtccgccaggctccaggaaaggggctggagtgggtggccaacataaaagaagatggaagtgagaaatactatgtagactctttgaagggccgattcaccatctccagagacaacgccaagaactcactgtatctgcaaatgaacagcctgagagccgaggacacgtctgtgtattactgtgcgagagttcgactctacagtgacttccttgactactggggccagggaaccctggtcaccgtctcctcag

SEQ ID NO: 80 - protein, 449 aa, Homo Sapien
EVQLVDSGGGLVQPGGSLRLSCAASGFTFSSYWMSWVRQAPGKGLEWVANIKEDGSEKYYVDSLKGRFTISRDNAKNSLYLQMNSLRAEDTSVYYCARVRLYSDFLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 81 - DNA, 1347 bp, Homo Sapien
gaggtgcagctggtggactctgggggaggcttggtccagcctggggggtccctgagactctcctgtgcagcctctggattcacgtttagtagctattggatgagttgggtccgccaggctccaggaaaggggctggagtgggtggccaacataaaagaagatggaagtgagaaatactatgtagactctttgaagggccgattcaccatctccagagacaacgccaagaactcactgtatctgcaaatgaacagcctgagagccgaggacacgtctgtgtattactgtgcgagagttcgactctacagtgacttccttgactactggggccagggaaccctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 82 - protein, 6 aa, Homo Sapien
QGVSSW

SEQ ID NO: 83 - protein, 3 aa, Homo Sapien
GAS

SEQ ID NO: 84 - protein, 9 aa, Homo Sapien
QQANSIPFT

SEQ ID NO: 85 - protein, 11 aa, Homo Sapien
RASQGVSSWLA

SEQ ID NO: 86 - protein, 7 aa, Homo Sapien
GASSLQS

SEQ ID NO: 87 - protein, 9 aa, Homo Sapien
QQANSIPFT

SEQ ID NO: 88 - protein, 107 aa, Homo Sapien
DIQMTQSPSSVSASVGDRVTITCRASQGVSSWLAWYQQKSGKAPKLLIYGASSLQSGVPSRFSGSGSGTEFILSISSLQPEDFATYYCQQANSIPFTFGPGTKVDIK

SEQ ID NO: 89 - DNA, 322 bp, Homo Sapien
gacatccagatgacccagtctccatcttccgtgtctgcatctgtcggagacagagtcaccatcacttgtcgggcgagtcagggtgttagcagttggttagcctggtatcagcagaaatcagggaaagcccctaagctcctgatctatggtgcctccagtttgcaaagtggggtcccatcaagattcagcggcagtggatctgggacagagttcattctcagcatcagcagcctgcagcctgaagattttgcaacttactattgtcaacaggctaacagtatcccattcactttcggccctgggaccaaagtggatatcaaac

SEQ ID NO: 90 - protein, 214 aa, Homo Sapien
DIQMTQSPSSVSASVGDRVTITCRASQGVSSWLAWYQQKSGKAPKLLIYGASSLQSGVPSRFSGSGSGTEFILSISSLQPEDFATYYCQQANSIPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 91 - DNA, 642 bp, Homo Sapien
gacatccagatgacccagtctccatcttccgtgtctgcatctgtcggagacagagtcaccatcacttgtcgggcgagtcagggtgttagcagttggttagcctggtatcagcagaaatcagggaaagcccctaagctcctgatctatggtgcctccagtttgcaaagtggggtcccatcaagattcagcggcagtggatctgggacagagttcattctcagcatcagcagcctgcagcctgaagattttgcaacttactattgtcaacaggctaacagtatcccattcactttcggccctgggaccaaagtggatatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 92 - protein, 9 aa, Homo Sapien
GGSIISSDW

SEQ ID NO: 93 - protein, 7 aa, Homo Sapien
IFHSGRT

SEQ ID NO: 94 - protein, 8 aa, Homo Sapien
ARDGSGSY

SEQ ID NO: 95 - protein, 6 aa, Homo Sapien
SSDWWN

SEQ ID NO: 96 - protein, 16 aa, Homo Sapien
EIFHSGRTNYNPSLKS

SEQ ID NO: 97 - protein, 6 aa, Homo Sapien
DGSGSY

SEQ ID NO: 98 - protein, 115 aa, Homo Sapien
QVQLQESGPGLVKPSGTLSLTCIVSGGSIISSDWWNWVRQPPGKGLEWIGEIFHSGRTNYNPSLKSRVTISIDKSKNQFSLRLSSVTAADTAVYYCARDGSGSYWGQGTLVTVSS

SEQ ID NO: 99 - DNA, 346 bp, Homo Sapien
caggtgcagctgcaggagtcgggcccaggactggtgaagccttcggggaccctgtccctcacctgcattgtctctggtggctccatcatcagtagtgactggtggaattgggtccgccagcccccagggaaggggctggagtggattggagaaatctttcatagtgggaggaccaactacaacccgtccctcaagagtcgagtcaccatatcaatagacaagtccaagaatcagttctccctgaggctgagctctgtgaccgccgcggacacggccgtgtattactgtgcgagagatggttcggggagttactggggccagggaaccctggtcaccgtctcctcag

SEQ ID NO: 100 - protein, 445 aa, Homo Sapien
QVQLQESGPGLVKPSGTLSLTCIVSGGSIISSDWWNWVRQPPGKGLEWIGEIFHSGRTNYNPSLKSRVTISIDKSKNQFSLRLSSVTAADTAVYYCARDGSGSYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 101 - DNA, 1335 bp, Homo Sapien
caggtgcagctgcaggagtcgggcccaggactggtgaagccttcggggaccctgtccctcacctgcattgtctctggtggctccatcatcagtagtgactggtggaattgggtccgccagcccccagggaaggggctggagtggattggagaaatctttcatagtgggaggaccaactacaacccgtccctcaagagtcgagtcaccatatcaatagacaagtccaagaatcagttctccctgaggctgagctctgtgaccgccgcggacacggccgtgtattactgtgcgagagatggttcggggagttactggggccagggaaccctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 102 - protein, 12 aa, Homo Sapien
QSVLYSSNNKNY

SEQ ID NO: 103 - protein, 3 aa, Homo Sapien
WAS

SEQ ID NO: 104 - protein, 8 aa, Homo Sapien
QQYYSNRS

SEQ ID NO: 105 - protein, 17 aa, Homo Sapien
KSSQSVLYSSNNKNYLA

SEQ ID NO: 106 - protein, 7 aa, Homo Sapien
WASTRES

SEQ ID NO: 107 - protein, 8 aa, Homo Sapien
QQYYSNRS

SEQ ID NO: 108 - protein, 112 aa, Homo Sapien
DIVMTQSPDSLAVSLGERATINCKSSQSVLYSSNNKNYLAWYQQKSGQPPKLLIYWASTRESGVPDRFSGSGSGTDFTLTISSLQTEDVAVYYCQQYYSNRSFGQGTKLEIK

SEQ ID NO: 109 - DNA, 337 bp, Homo Sapien
gacatcgtgatgacccagtctccagactccctggctgtgtctctgggcgagagggccaccatcaactgcaagtccagccagagtgttttatacagctccaacaataagaattacttagcttggtaccagcagaaatcaggacagcctcctaagttgctcatttactgggcatctacccgggaatccggggtccctgaccgattcagtggcagcgggtctgggacagatttcactctcaccatcagcagcctgcagactgaagatgtggcagtttattactgtcagcaatattatagtaatcgcagttttggccaggggaccaagctggagatcaaac

SEQ ID NO: 110 - protein, 219 aa, Homo Sapien
DIVMTQSPDSLAVSLGERATINCKSSQSVLYSSNNKNYLAWYQQKSGQPPKLLIYWASTRESGVPDRFSGSGSGTDFTLTISSLQTEDVAVYYCQQYYSNRSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 111 - DNA, 657 bp, Homo Sapien
gacatcgtgatgacccagtctccagactccctggctgtgtctctgggcgagagggccaccatcaactgcaagtccagccagagtgttttatacagctccaacaataagaattacttagcttggtaccagcagaaatcaggacagcctcctaagttgctcatttactgggcatctacccgggaatccggggtccctgaccgattcagtggcagcgggtctgggacagatttcactctcaccatcagcagcctgcagactgaagatgtggcagtttattactgtcagcaatattatagtaatcgcagttttggccaggggaccaagctggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 112 - protein, 8 aa, Homo Sapien
GFTFSSYW

SEQ ID NO: 113 - protein, 8 aa, Homo Sapien
IKEDGSEK

SEQ ID NO: 114 - protein, 12 aa, Homo Sapien
ARNRLYSDFLDN

SEQ ID NO: 115 - protein, 5 aa, Homo Sapien
SYWMS

SEQ ID NO: 116 - protein, 17 aa, Homo Sapien
NIKEDGSEKYYVDSVKG

SEQ ID NO: 117 - protein, 10 aa, Homo Sapien
NRLYSDFLDN

SEQ ID NO: 118 - protein, 119 aa, Homo Sapien; identical to SEQ ID NO: 58

SEQ ID NO: 119 - DNA, 358 bp, Homo Sapien; identical to SEQ ID NO: 59

SEQ ID NO: 120 - protein, 449 aa, Homo Sapien; identical to SEQ ID NO: 60

SEQ ID NO: 121 - DNA, 1347 bp, Homo Sapien; identical to SEQ ID NO: 61

SEQ ID NO: 122 - protein, 6 aa, Homo Sapien
QGVSSW

SEQ ID NO: 123 - protein, 3 aa, Homo Sapien
GAS

SEQ ID NO: 124 - protein, 9 aa, Homo Sapien
QQANSIPFT

SEQ ID NO: 125 - protein, 11 aa, Homo Sapien
RASQGVSSWLA

SEQ ID NO: 126 - protein, 7 aa, Homo Sapien
GASSLQS

SEQ ID NO: 127 - protein, 9 aa, Homo Sapien
QQANSIPFT

SEQ ID NO: 128 - protein, 107 aa, Homo Sapien; identical to SEQ ID NO: 68

SEQ ID NO: 129 - DNA, 322 bp, Homo Sapien; identical to SEQ ID NO: 69

SEQ ID NO: 130 - protein, 214 aa, Homo Sapien; identical to SEQ ID NO: 70

SEQ ID NO: 131 - DNA, 642 bp, Homo Sapien; identical to SEQ ID NO: 71

SEQ ID NO: 132 - protein, 8 aa, Homo Sapien
GFTFRIYG

SEQ ID NO: 133 - protein, 8 aa, Homo Sapien
IWYDGSNK

SEQ ID NO: 134 - protein, 11 aa, Homo Sapien
ARDMDYFGMDV

SEQ ID NO: 135 - protein, 5 aa, Homo Sapien
IYGMH

SEQ ID NO: 136 - protein, 17 aa, Homo Sapien
VIWYDGSNKYYADSVKG

SEQ ID NO: 137 - protein, 9 aa, Homo Sapien
DMDYFGMDV

SEQ ID NO: 138 - protein, 118 aa, Homo Sapien
QVQLVESGGGVVQPGRSLRLSCAASGFTFRIYGMHWVRQAPGKGLEWVAVIWYDGSNKYYADSVKGRFTISRDNSDNTLYLQMNSLRAEDTAVYYCARDMDYFGMDVWGQGTTVTVSS

SEQ ID NO: 139 - DNA, 355 bp, Homo Sapien
caggtgcagctggtggagtctgggggaggcgtggtccagcctgggaggtccctgagactctcctgtgcagcgtctggattcaccttccgtatttatggcatgcactgggtccgccaggctccaggcaaggggctggagtgggtggcagttatatggtatgatggaagtaataaatactatgctgactccgtgaagggccgattcaccatctccagagacaattccgacaacacgctgtatctgcaaatgaacagcctgagagccgaggacacggctgtgtattactgtgcgagagatatggactacttcggtatggacgtctggggccaagggaccacggtcaccgtctcctcag

SEQ ID NO: 140 - protein, 448 aa, Homo Sapien
QVQLVESGGGVVQPGRSLRLSCAASGFTFRIYGMHWVRQAPGKGLEWVAVIWYDGSNKYYADSVKGRFTISRDNSDNTLYLQMNSLRAEDTAVYYCARDMDYFGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 141 - DNA, 1344 bp, Homo Sapien
caggtgcagctggtggagtctgggggaggcgtggtccagcctgggaggtccctgagactctcctgtgcagcgtctggattcaccttccgtatttatggcatgcactgggtccgccaggctccaggcaaggggctggagtgggtggcagttatatggtatgatggaagtaataaatactatgctgactccgtgaagggccgattcaccatctccagagacaattccgacaacacgctgtatctgcaaatgaacagcctgagagccgaggacacggctgtgtattactgtgcgagagatatggactacttcggtatggacgtctggggccaagggaccacggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 142 - protein, 6 aa, Homo Sapien
QGIRND

SEQ ID NO: 143 - protein, 3 aa, Homo Sapien
AAS

SEQ ID NO: 144 - protein, 9 aa, Homo Sapien
LQHNSYPRT

SEQ ID NO: 145 - protein, 11 aa, Homo Sapien
RASQGIRNDLG

SEQ ID NO: 146 - protein, 7 aa, Homo Sapien
AASSLQS

SEQ ID NO: 147 - protein, 9 aa, Homo Sapien
LQHNSYPRT

SEQ ID NO: 148 - protein, 107 aa, Homo Sapien
DLQMTQSPSSLSASVGDRVTITCRASQGIRNDLGWYQQKPGKAPKRLIYAASSLQSGVPSRFSGSGSGTEFTLTISSLQPEDFATYYCLQHNSYPRTFGQGTKVEIK

SEQ ID NO: 149 - DNA, 322 bp, Homo Sapien
gacctccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttaccctcggacgttcggccaagggaccaaggtggaaatcaaac

SEQ ID NO: 150 - protein, 214 aa, Homo Sapien
DLQMTQSPSSLSASVGDRVTITCRASQGIRNDLGWYQQKPGKAPKRLIYAASSLQSGVPSRFSGSGSGTEFTLTISSLQPEDFATYYCLQHNSYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 151 - DNA, 642 bp, Homo Sapien
gacctccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttaccctcggacgttcggccaagggaccaaggtggaaatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 152 - protein, 9 aa, Homo Sapien
GGSISSSDW

SEQ ID NO: 153 - protein, 7 aa, Homo Sapien
IFHSGNT

SEQ ID NO: 154 - protein, 8 aa, Homo Sapien
VRDGSGSY

SEQ ID NO: 155 - protein, 6 aa, Homo Sapien
SSDWWS

SEQ ID NO: 156 - protein, 16 aa, Homo Sapien
EIFHSGNTNYNPSLKS

SEQ ID NO: 157 - protein, 6 aa, Homo Sapien
DGSGSY

SEQ ID NO: 158 - protein, 115 aa, Homo Sapien
QVQLQESGPGLVKPSGTLSLTCAVSGGSISSSDWWSWVRQPPGKGLEWIGEIFHSGNTNYNPSLKSRVTISVDKSKNQISLRLNSVTAADTAVYYCVRDGSGSYWGQGTLVTVSS

SEQ ID NO: 159 - DNA, 346 bp, Homo Sapien
caggtgcagctgcaggagtcgggcccaggactggtgaagccttcggggaccctgtccctcacctgcgctgtctctggtggctccatcagcagtagtgactggtggagttgggtccgccagcccccagggaaggggctggagtggattggggaaatctttcatagtgggaacaccaactacaacccgtccctcaagagtcgagtcaccatatcagtagacaagtccaagaaccagatctccctgaggctgaactctgtgaccgccgcggacacggccgtgtattactgtgtgagagatggttcggggagttactggggccagggaaccctggtcaccgtctcctcag

SEQ ID NO: 160 - protein, 445 aa, Homo Sapien
QVQLQESGPGLVKPSGTLSLTCAVSGGSISSSDWWSWVRQPPGKGLEWIGEIFHSGNTNYNPSLKSRVTISVDKSKNQISLRLNSVTAADTAVYYCVRDGSGSYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 161 - DNA, 1335 bp, Homo Sapien
caggtgcagctgcaggagtcgggcccaggactggtgaagccttcggggaccctgtccctcacctgcgctgtctctggtggctccatcagcagtagtgactggtggagttgggtccgccagcccccagggaaggggctggagtggattggggaaatctttcatagtgggaacaccaactacaacccgtccctcaagagtcgagtcaccatatcagtagacaagtccaagaaccagatctccctgaggctgaactctgtgaccgccgcggacacggccgtgtattactgtgtgagagatggttcggggagttactggggccagggaaccctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 162 - protein, 12 aa, Homo Sapien
QSVLYSSNNKNY

SEQ ID NO: 163 - protein, 3 aa, Homo Sapien
WAS

SEQ ID NO: 164 - protein, 8 aa, Homo Sapien
QQYYSTRS

SEQ ID NO: 165 - protein, 17 aa, Homo Sapien
KSSQSVLYSSNNKNYLA

SEQ ID NO: 166 - protein, 7 aa, Homo Sapien
WASTRES

SEQ ID NO: 167 - protein, 8 aa, Homo Sapien
QQYYSTRS

SEQ ID NO: 168 - protein, 112 aa, Homo Sapien
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTRSFGQGTKLEIK

SEQ ID NO: 169 - DNA, 337 bp, Homo Sapien
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaaactgctcatttactgggcatctacccgggaatccggggtccctgaccgattcagtggcagcgggtctgggacagatttcactctcaccatcagcagcctgcaggctgaagatgtggcagtttattactgtcagcaatattatagtactcgcagttttggccaggggaccaagctggagatcaaac

SEQ ID NO: 170 - protein, 219 aa, Homo Sapien
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTRSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 171 - DNA, 657 bp, Homo Sapien
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaaactgctcatttactgggcatctacccgggaatccggggtccctgaccgattcagtggcagcgggtctgggacagatttcactctcaccatcagcagcctgcaggctgaagatgtggcagtttattactgtcagcaatattatagtactcgcagttttggccaggggaccaagctggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 172 - protein, 10 aa, Homo Sapien
GGSISSSSYY

SEQ ID NO: 173 - protein, 7 aa, Homo Sapien
IYSTGYT

SEQ ID NO: 174 - protein, 13 aa, Homo Sapien
AISTAAGPEYFHR

SEQ ID NO: 175 - protein, 7 aa, Homo Sapien
SSSYYCG

SEQ ID NO: 176 - protein, 16 aa, Homo Sapien
SIYSTGYTYYNPSLKS

SEQ ID NO: 177 - protein, 11 aa, Homo Sapien
STAAGPEYFHR

SEQ ID NO: 178 - protein, 120 aa, Homo Sapien
QLQESGPGLVKPSETLSLTCTVSGGSISSSSYYCGWIRQPPGKGLDWIGSIYSTGYTYYNPSLKSRVTISIDTSKNQFSCLILTSVTAADTAVYYCAISTAAGPEYFHRWGQGTLVTVSS

SEQ ID NO: 179 - DNA, 361 bp, Homo Sapien
cagctgcaggagtcgggcccaggcctggtgaagccttcggagaccctgtccctcacctgcactgtctctggtggctccatcagcagtagtagttattactgcggctggatccgccagccccctgggaaggggctggactggattgggagtatctattctactgggtacacctactacaacccgtccctcaagagtcgagtcaccatttccatagacacgtccaagaaccagttctcatgcctgatactgacctctgtgaccgccgcagacacggctgtgtattactgtgcgataagtacagcagctggccctgaatacttccatcgctggggccagggcaccctggtcaccgtctcctcag

SEQ ID NO: 180 - protein, 450 aa, Homo Sapien
QLQESGPGLVKPSETLSLTCTVSGGSISSSSYYCGWIRQPPGKGLDWIGSIYSTGYTYYNPSLKSRVTISIDTSKNQFSCLILTSVTAADTAVYYCAISTAAGPEYFHRWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 181 - DNA, 1350 bp, Homo Sapien
cagctgcaggagtcgggcccaggcctggtgaagccttcggagaccctgtccctcacctgcactgtctctggtggctccatcagcagtagtagttattactgcggctggatccgccagccccctgggaaggggctggactggattgggagtatctattctactgggtacacctactacaacccgtccctcaagagtcgagtcaccatttccatagacacgtccaagaaccagttctcatgcctgatactgacctctgtgaccgccgcagacacggctgtgtattactgtgcgataagtacagcagctggccctgaatacttccatcgctggggccagggcaccctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 182 - protein, 12 aa, Homo Sapien
QSVLYSSNSKNF

SEQ ID NO: 183 - protein, 3 aa, Homo Sapien
WAS

SEQ ID NO: 184 - protein, 9 aa, Homo Sapien
QQYYSTPRT

SEQ ID NO: 185 - protein, 17 aa, Homo Sapien
KSSQSVLYSSNSKNFLA

SEQ ID NO: 186 - protein, 7 aa, Homo Sapien
WASTRGS

SEQ ID NO: 187 - protein, 9 aa, Homo Sapien
QQYYSTPRT

SEQ ID NO: 188 - protein, 113 aa, Homo Sapien
DIVMTQSPDSLAVSLGERATINCKSSQSVLYSSNSKNFLAWYQQKPGQPPKLFIYWASTRGSGVPDRISGSGSGTDFNLTISSLQAEDVAVYYCQQYYSTPRTFGQGTKVEIK

SEQ ID NO: 189 - DNA, 340 bp, Homo Sapien
gacatcgtgatgacccagtctccagactccctggctgtgtctctgggcgagagggccaccatcaactgcaagtccagccagagtgttttatacagctccaacagtaagaacttcttagcttggtaccagcagaaaccgggacagcctcctaagctgttcatttactgggcatctacccggggatccggggtccctgaccgaatcagtggcagcgggtctgggacagatttcaatctcaccatcagcagcctgcaggctgaagatgtggcagtttattactgtcaacaatattatagtactcctcggacgttcggccaagggaccaaggtggagatcaaac

SEQ ID NO: 190 - protein, 220 aa, Homo Sapien
DIVMTQSPDSLAVSLGERATINCKSSQSVLYSSNSKNFLAWYQQKPGQPPKLFIYWASTRGSGVPDRISGSGSGTDFNLTISSLQAEDVAVYYCQQYYSTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 191 - DNA, 660 bp, Homo Sapien
gacatcgtgatgacccagtctccagactccctggctgtgtctctgggcgagagggccaccatcaactgcaagtccagccagagtgttttatacagctccaacagtaagaacttcttagcttggtaccagcagaaaccgggacagcctcctaagctgttcatttactgggcatctacccggggatccggggtccctgaccgaatcagtggcagcgggtctgggacagatttcaatctcaccatcagcagcctgcaggctgaagatgtggcagtttattactgtcaacaatattatagtactcctcggacgttcggccaagggaccaaggtggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 192 - DNA, 981 bp, Homo Sapien
gcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaa

SEQ ID NO: 193 - protein, 327 aa, Homo Sapien
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 194 - DNA, 981 bp, Homo Sapien
gcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccgtgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcgtgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacgcagaagagcctctccctgtctctgggtaaa

SEQ ID NO: 195 - protein, 327 aa, Homo Sapien
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVVHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 196 - DNA, 981 bp, Homo Sapien
gcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaagctcaccgtggacaagagcaggtggcaggaggggaacgtcttctcatgctccgtgatgcatgaggctctgcacaaccactacacgcagaagagcctctccctgtctctgggtaaa

SEQ ID NO: 197 - protein, 327 aa, Homo Sapien
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 198 - DNA, 981 bp, Homo Sapien
gcctccaccaagggcccatccgtcttccccctggcgccctgctccaggagcacctccgagagcacggccgccctgggctgcctggtcaaggactacttccccgaaccagtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcgcctgaatttgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcatcgatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggatccttcttcctctacagcaggctaaccgtggacaagagcaggtggcaggaggggaatgtcttctcatgctccgtgatgcatgaggctctgcacaaccactacacacagaagagcctctccctgtctctgggtaaa

SEQ ID NO: 199 - protein, 327 aa, Homo Sapien
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 200 - DNA, 981 bp, Homo Sapien
gcctccaccaagggacctagcgtgttccctctcgccccctgttccaggtccacaagcgagtccaccgctgccctcggctgtctggtgaaagactactttcccgagcccgtgaccgtctcctggaatagcggagccctgacctccggcgtgcacacatttcccgccgtgctgcagagcagcggactgtatagcctgagcagcgtggtgaccgtgcccagctccagcctcggcaccaaaacctacacctgcaacgtggaccacaagccctccaacaccaaggtggacaagcgggtggagagcaagtacggccccccttgccctccttgtcctgcccctgagttcgagggaggaccctccgtgttcctgtttccccccaaacccaaggacaccctgatgatctcccggacacccgaggtgacctgtgtggtcgtggacgtcagccaggaggaccccgaggtgcagttcaactggtatgtggacggcgtggaggtgcacaatgccaaaaccaagcccagggaggagcagttcaattccacctacagggtggtgagcgtgctgaccgtcctgcatcaggattggctgaacggcaaggagtacaagtgcaaggtgtccaacaagggactgcccagctccatcgagaagaccatcagcaaggctaagggccagccgagggagccccaggtgtataccctgcctcctagccaggaagagatgaccaagaaccaagtgtccctgacctgcctggtgaagggattctacccctccgacatcgccgtggagtgggagagcaatggccagcccgagaacaactacaaaacaacccctcccgtgctcgatagcgacggcagcttctttctctacagccggctgacagtggacaagagcaggtggcaggagggcaacgtgttctcctgttccgtgatgcacgaggccctgcacaatcactacacccagaagagcctctccctgtccctgggcaag

SEQ ID NO: 201 - DNA, 981 bp, Homo Sapien
gccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 202 - DNA, 981 bp, Homo Sapien
gcctccaccaagggcccatccgtcttccccctggcgccctgctccaggagcacctccgagagcacggccgccctgggctgcctggtcaaggactacttccccgaaccagtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcgcctccagttgcggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcatcgatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggatccttcttcctctacagcaggctaaccgtggacaagagcaggtggcaggaggggaatgtcttctcatgctccgtgatgcatgaggctctgcacaaccactacacacagaagagcctctccctgtctctgggtaaa

SEQ ID NO: 203 - protein, 327 aa, Homo Sapien
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPPVAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 204 - DNA, 990 bp, Homo Sapien
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagtggagcccaaatcttgtgacaaaactcacacatgcccaccgtgcccagcacctgaactcgcgggggcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 205 - protein, 330 aa, Homo Sapien
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 206 - DNA, 321 bp, Homo Sapien
cgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 207 - protein, 107 aa, Homo Sapien [sequence omitted]

SEQ ID NO: 208 - DNA, 321 bp, Homo Sapien
cgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggagagcaaggacagcacctacagcctcagcagcaccctgacgctgagcaaagcagactacgagaaacacaaagtctacgccggcgaagtcacccatcagggcctgagctcgcccgtcacaaagagcttcaacaggggagagtgt

SEQ ID NO: 209 - protein, 107 aa, Homo Sapien
RTVAAPSVFIFPPSDEQLKSGTASVVCLLNNFYPREAKVQWKVDNALQSGNSQESVTEQESKDSTYSLSSTLTLSKADYEKHKVYAGEVTHQGLSSPVTKSFNRGEC

SEQ ID NO: 210 - DNA, 321 bp, Homo Sapien
cgaactgtggctgcaccatctgtcttcatcttcccgccatctgatgagcagttgaaatctggaactgcctctgttgtgtgcctgctgaataacttctatcccagagaggccaaagtacagcggaaggtggataacgccctccaatcgggtaactcccaggagagtgtcacagagcaggagagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 211 - protein, 107 aa, Homo Sapien
RTVAAPSVFIFPPSDEQLKSGTASVVCLLNNFYPREAKVQRKVDNALQSGNSQESVTEQESKDSTYSLSSTLTLSKADYEKHKVYACEVTHQGLSSPVTKSFNRGEC

SEQ ID NO: 212 - DNA, 321 bp, Homo Sapien
cgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaactctacgcctgcgaagtcacccatcagggcctgagctcgcccgtcacaaagagcttcaacaggggagagtgt

SEQ ID NO: 213 - protein, 107 aa, Homo Sapien
RTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 214 - DNA, 321 bp, Homo Sapien
cgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcaacaccctgacgctgagcaaagcagactacgagaaacacaaagtctacgcctgcgaagtcacccatcagggcctgagctcgcccgtcacaaagagcttcaacaggggagagtgc

SEQ ID NO: 215 - protein, 107 aa, Homo Sapien
RTVAAPSVFIFPPSDEQLKSGTASVVCLLNNFYPREAKVQWKVDNALQSGNSQESVTEQDSKDSTYSLSNTLTLSKADYEKHKVYACEVTHQGLSSPVTKSFNRGEC

SEQ ID NO: 216 - DNA, 312 bp, Homo Sapien
cccaaggccaaccccacggtcactctgttcccgccctcctctgaggagctccaagccaacaaggccacactagtgtgtctgatcagtgacttctacccgggagctgtgacagtggcttggaaggcagatggcagccccgtcaaggcgggagtggagacgaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 217 - protein, 104 aa, Homo Sapien
PKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 218 - DNA, 318 bp, Homo Sapien
ggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 219 - protein, 106 aa, Homo Sapien
GQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 220 - DNA, 318 bp, Homo Sapien; identical to SEQ ID NO: 218

SEQ ID NO: 221 - DNA, 318 bp, Homo Sapien
ggccagcctaaggccgctccttctgtgaccctgttccccccatcctccgaggaactgcaggctaacaaggccaccctcgtgtgcctgatcagcgacttctaccctggcgccgtgaccgtggcctggaaggctgatagctctcctgtgaaggccggcgtggaaaccaccaccccttccaagcagtccaacaacaaatacgccgcctcctcctacctgtccctgacccctgagcagtggaagtcccaccggtcctacagctgccaagtgacccacgagggctccaccgtggaaaagaccgtggctcctaccgagtgctcc

SEQ ID NO: 222 - DNA, 318 bp, Homo Sapien
ggccagcctaaagctgcccccagcgtcaccctgtttcctccctccagcgaggagctccaggccaacaaggccaccctcgtgtgcctgatctccgacttctatcccggcgctgtgaccgtggcttggaaagccgactccagccctgtcaaagccggcgtggagaccaccacaccctccaagcagtccaacaacaagtacgccgcctccagctatctctccctgacccctgagcagtggaagtcccaccggtcctactcctgtcaggtgacccacgagggctccaccgtggaaaagaccgtcgcccccaccgagtgctcc

SEQ ID NO: 223 - protein, 106 aa, Homo Sapien; identical to SEQ ID NO: 219

SEQ ID NO: 224 - DNA, 318 bp, Homo Sapien
ggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 225 - protein, 106 aa, Homo Sapien
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 226 - DNA, 312 bp, Homo Sapien
cccaaggctgccccctcggtcactctgttcccaccctcctctgaggagcttcaagccaacaaggccacactggtgtgtctcataagtgacttctacccgggagccgtgacagttgcctggaaggcagatagcagccccgtcaaggcgggggtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagttgcccctacggaatgttca

SEQ ID NO: 227 - protein, 104 aa, Homo Sapien
PKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 228 - DNA, 318 bp, Homo Sapien
ggtcagcccaaggctgccccctcggtcactctgttcccaccctcctctgaggagcttcaagccaacaaggccacactggtgtgtctcataagtgacttctacccggggccagtgacagttgcctggaaggcagatagcagccccgtcaaggcgggggtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacggaatgttca

SEQ ID NO: 229 - protein, 106 aa, Homo Sapien
GQPKAAPSVTLFPPSSEELQANKATLVCLISDFYPGPVTVAWKADSSPVKAGVETTTPSKQSNNKYAASSYLSLTPEQWKSHKSYSCQVTHEGSTVEKTVAPTECS

SEQ ID NO: 230 - DNA, 318 bp, Homo Sapien
ggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 231 - protein, 106 aa, Homo Sapien
GQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 232 - DNA, 318 bp, Homo Sapien
ggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttca

SEQ ID NO: 233 - protein, 106 aa, Homo Sapien; identical to SEQ ID NO: 225

SEQ ID NO: 234 - DNA, 318 bp, Homo Sapien
ggtcagcccaaggctgccccatcggtcactctgttcccgccctcctctgaggagcttcaagccaacaaggccacactggtgtgcctgatcagtgacttctacccgggagctgtgaaagtggcctggaaggcagatggcagccccgtcaacacgggagtggagaccaccacaccctccaaacagagcaacaacaagtacgcggccagcagctacctgagcctgacgcctgagcagtggaagtcccacagaagctacagctgccaggtcacgcatgaagggagcaccgtggagaagacagtggcccctgcagaatgttca

SEQ ID NO: 235 - protein, 106 aa, Homo Sapien
GQPKAAPSVTLFPPSSEELQANKATLVCLISDFYPGAVKVAWKADGSPVNTGVETTTPSKQSNNKYAASSYLSLTPEQWKSHRSYSCQVTHEGSTVEKTVAPAECS

SEQ ID NO: 236 - DNA, 318 bp, Homo Sapien
ggtcagcccaaggctgccccatcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 237 - protein, 106 aa, Homo Sapien
GQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 238 - protein, 8 aa, Homo Sapien
GFTFSDYY

SEQ ID NO: 239 - protein, 8 aa, Homo Sapien
ISTSGSTI

SEQ ID NO: 240 - protein, 16 aa, Homo Sapien
ARGITGTNFYHYGLGV

SEQ ID NO: 241 - protein, 5 aa, Homo Sapien
DYYMS

SEQ ID NO: 242 - protein, 17 aa, Homo Sapien
YISTSGSTIYYADSVKG

SEQ ID NO: 243 - protein, 14 aa, Homo Sapien
GITGTNFYHYGLGV

SEQ ID NO: 244 - protein, 123 aa, Homo Sapien
QVQLVESGGGLVKPGGSLRLSCAASGFTFSDYYMSWIRQVPGKGLEWVSYISTSGSTIYYADSVKGRFTISRDNAKNSLYLQMNSLRAEDAAVYHCARGITGTNFYHYGLGVWGQGTTVTVSS

SEQ ID NO: 245 - DNA, 370 bp, Homo Sapien
caggtgcagctggtggagtctgggggaggcttggtcaagcctggagggtccctgagactctcctgtgcagcctctggattcaccttcagtgactactacatgagctggatccgccaggttccagggaaggggctggagtgggtttcatacattagtactagtggtagtaccatatactacgcagactctgtgaagggccgattcaccatctccagggacaacgccaagaactcactgtatctacaaatgaacagcctgagagccgaggacgcggccgtgtatcactgtgcgagaggtataactggaactaacttctaccactacggtttgggcgtctggggccaagggaccacggtcaccgtctcctcag

SEQ ID NO: 246 - protein, 453 aa, Homo Sapien
QVQLVESGGGLVKPGGSLRLSCAASGFTFSDYYMSWIRQVPGKGLEWVSYISTSGSTIYYADSVKGRFTISRDNAKNSLYLQMNSLRAEDAAVYHCARGITGTNFYHYGLGVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 247 - DNA, 1359 bp, Homo Sapien
caggtgcagctggtggagtctgggggaggcttggtcaagcctggagggtccctgagactctcctgtgcagcctctggattcaccttcagtgactactacatgagctggatccgccaggttccagggaaggggctggagtgggtttcatacattagtactagtggtagtaccatatactacgcagactctgtgaagggccgattcaccatctccagggacaacgccaagaactcactgtatctacaaatgaacagcctgagagccgaggacgcggccgtgtatcactgtgcgagaggtataactggaactaacttctaccactacggtttgggcgtctggggccaagggaccacggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 248 - protein, 6 aa, Homo Sapien
QGINSW

SEQ ID NO: 249 - protein, 3 aa, Homo Sapien
AAS

SEQ ID NO: 250 - protein, 9 aa, Homo Sapien
QQVNSFPLT

SEQ ID NO: 251 - protein, 11 aa, Homo Sapien
RASQGINSWLA

SEQ ID NO: 252 - protein, 7 aa, Homo Sapien
AASTLQS

SEQ ID NO: 253 - protein, 9 aa, Homo Sapien
QQVNSFPLT

SEQ ID NO: 254 - protein, 107 aa, Homo Sapien
DIQMTQSPSSVSASVGDRVTITCRASQGINSWLAWYQQKPGKAPKLLIYAASTLQSGVPSRFSGSGSGADFTLTISSLQPEDFATYYCQQVNSFPLTFGGGTKVEIK

SEQ ID NO: 255 - DNA, 322 bp, Homo Sapien
gacatccagatgacccagtctccatcttccgtgtctgcatctgtaggagacagagtcaccatcacttgtcgggcgagtcagggtattaacagctggttagcctggtatcagcagaaaccagggaaagcccctaagctcctgatctatgctgcatccactttgcaaagtggggtcccatcaaggttcagcggcagtgggtctggggcagatttcactctcaccatcagcagcctgcagcctgaagattttgcaacttactattgtcaacaggttaacagtttcccgctcactttcggcggagggaccaaggtggagatcaaac

SEQ ID NO: 256 - protein, 214 aa, Homo Sapien
DIQMTQSPSSVSASVGDRVTITCRASQGINSWLAWYQQKPGKAPKLLIYAASTLQSGVPSRFSGSGSGADFTLTISSLQPEDFATYYCQQVNSFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 257 - DNA, 642 bp, Homo Sapien
gacatccagatgacccagtctccatcttccgtgtctgcatctgtaggagacagagtcaccatcacttgtcgggcgagtcagggtattaacagctggttagcctggtatcagcagaaaccagggaaagcccctaagctcctgatctatgctgcatccactttgcaaagtggggtcccatcaaggttcagcggcagtgggtctggggcagatttcactctcaccatcagcagcctgcagcctgaagattttgcaacttactattgtcaacaggttaacagtttcccgctcactttcggcggagggaccaaggtggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 258 - protein, 8 aa, Homo Sapien
GFTFSYYA

SEQ ID NO: 259 - protein, 8 aa, Homo Sapien
ISGGGGNT

SEQ ID NO: 260 - protein, 16 aa, Homo Sapien
AKDRMKQLVRAYYFDY

SEQ ID NO: 261 - protein, 5 aa, Homo Sapien
YYAMS

SEQ ID NO: 262 - protein, 17 aa, Homo Sapien
TISGGGGNTHYADSVKG

SEQ ID NO: 263 - protein, 14 aa, Homo Sapien
DRMKQLVRAYYFDY

SEQ ID NO: 264 - protein, 123 aa, Homo Sapien
EVPLVESGGGLVQPGGSLRLSCAASGFTFSYYAMSWVRQAPGKGLDWVSTISGGGGNTHYADSVKGRFTISRDNSKNTLYLHMNSLRAEDTAVYYCAKDRMKQLVRAYYFDYWGQGTLVTVSS

SEQ ID NO: 265 - DNA, 370 bp, Homo Sapien
gaggtgccgctggtggagtctgggggaggcttggtacagcctggggggtccctgagactctcctgtgcagcctctggattcacgtttagctactatgccatgagctgggtccgtcaggctccagggaaggggctggactgggtctcaactattagtggtggtggtggtaacacacactacgcagactccgtgaagggccgattcactatatccagagacaattccaagaacacgctgtatctgcacatgaacagcctgagagccgaagacacggccgtctattactgtgcgaaggatcggatgaaacagctcgtccgggcctactactttgactactggggccagggaaccctggtcaccgtctcctcag

SEQ ID NO: 266 - protein, 453 aa, Homo Sapien
EVPLVESGGGLVQPGGSLRLSCAASGFTFSYYAMSWVRQAPGKGLDWVSTISGGGGNTHYADSVKGRFTISRDNSKNTLYLHMNSLRAEDTAVYYCAKDRMKQLVRAYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 267 - DNA, 1359 bp, Homo Sapien
gaggtgccgctggtggagtctgggggaggcttggtacagcctggggggtccctgagactctcctgtgcagcctctggattcacgtttagctactatgccatgagctgggtccgtcaggctccagggaaggggctggactgggtctcaactattagtggtggtggtggtaacacacactacgcagactccgtgaagggccgattcactatatccagagacaattccaagaacacgctgtatctgcacatgaacagcctgagagccgaagacacggccgtctattactgtgcgaaggatcggatgaaacagctcgtccgggcctactactttgactactggggccagggaaccctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 268 - protein, 6 aa, Homo Sapien
QDISTY

SEQ ID NO: 269 - protein, 3 aa, Homo Sapien
GTS

SEQ ID NO: 270 - protein, 9 aa, Homo Sapien
QQLHTDPIT

SEQ ID NO: 271 - protein, 11 aa, Homo Sapien
WASQDISTYLG

SEQ ID NO: 272 - protein, 7 aa, Homo Sapien
GTSSLQS

SEQ ID NO: 273 - protein, 9 aa, Homo Sapien
QQLHTDPIT

SEQ ID NO: 274 - protein, 107 aa, Homo Sapien
DIQLTQSPSFLSASVGDRVTITCWASQDISTYLGWYQQKPGKAPKLLIYGTSSLQSGVPSRFSGSGSGTEFTLTISSLQPEDFATYYCQQLHTDPITFGQGTRLEIK

SEQ ID NO: 275 - DNA, 322 bp, Homo Sapien
gacatccagttgacccagtctccatccttcctgtctgcatctgtaggagacagagtcaccatcacttgctgggccagtcaggacattagcacttatttaggctggtatcagcaaaaaccagggaaagcccctaagctcctgatctatggtacatccagtttgcaaagtggggtcccatcaaggttcagcggcagtggatctgggacagaattcactctcacaatcagcagcctgcagcctgaagattttgcaacttattactgtcaacagcttcatactgacccgatcaccttcggccaagggacacgactggagatcaaac

SEQ ID NO: 276 - protein, 214 aa, Homo Sapien
DIQLTQSPSFLSASVGDRVTITCWASQDISTYLGWYQQKPGKAPKLLIYGTSSLQSGVPSRFSGSGSGTEFTLTISSLQPEDFATYYCQQLHTDPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 277 - DNA, 642 bp, Homo Sapien
gacatccagttgacccagtctccatccttcctgtctgcatctgtaggagacagagtcaccatcacttgctgggccagtcaggacattagcacttatttaggctggtatcagcaaaaaccagggaaagcccctaagctcctgatctatggtacatccagtttgcaaagtggggtcccatcaaggttcagcggcagtggatctgggacagaattcactctcacaatcagcagcctgcagcctgaagattttgcaacttattactgtcaacagcttcatactgacccgatcaccttcggccaagggacacgactggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 278 - protein, 8 aa, Homo Sapien
GFTFSSYW

SEQ ID NO: 279 - protein, 8 aa, Homo Sapien
IKQDGSEK

SEQ ID NO: 280 - protein, 12 aa, Homo Sapien
ARVRQWSDYSDY

SEQ ID NO: 281 - protein, 5 aa, Homo Sapien
SYWMN

SEQ ID NO: 282 - protein, 17 aa, Homo Sapien
NIKQDGSEKYYVDSVKG

SEQ ID NO: 283 - protein, 10 aa, Homo Sapien
VRQWSDYSDY

SEQ ID NO: 284 - protein, 119 aa, Homo Sapien
EVHLVESGGGLVQPGGSLRLSCAASGFTFSSYWMNWVRQAPGKGLEWVANIKQDGSEKYYVDSVKGRFTVSRDNAKNSLYLQMNSLRAEDTAVYYCARVRQWSDYSDYWGQGTPVTVSS

SEQ ID NO: 285 - DNA, 358 bp, Homo Sapien
gaggtgcacctggtggagtctgggggaggcttggtccagcctggggggtccctgagactctcctgtgcagcctctggattcacctttagtagctattggatgaactgggtccgccaggctccagggaaggggctggagtgggtggccaacataaagcaagatggaagtgagaaatactatgtggactctgtgaagggccgcttcaccgtctccagagacaacgccaagaactcactgtatctgcaaatgaacagcctgagagccgaggacacggctgtgtattactgtgcgagagttcgacaatggtccgactactctgactactggggccagggaaccccggtcaccgtctcctcag

SEQ ID NO: 286 - protein, 449 aa, Homo Sapien
EVHLVESGGGLVQPGGSLRLSCAASGFTFSSYWMNWVRQAPGKGLEWVANIKQDGSEKYYVDSVKGRFTVSRDNAKNSLYLQMNSLRAEDTAVYYCARVRQWSDYSDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 287 - DNA, 1347 bp, Homo Sapien
gaggtgcacctggtggagtctgggggaggcttggtccagcctggggggtccctgagactctcctgtgcagcctctggattcacctttagtagctattggatgaactgggtccgccaggctccagggaaggggctggagtgggtggccaacataaagcaagatggaagtgagaaatactatgtggactctgtgaagggccgcttcaccgtctccagagacaacgccaagaactcactgtatctgcaaatgaacagcctgagagccgaggacacggctgtgtattactgtgcgagagttcgacaatggtccgactactctgactactggggccagggaaccccggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 288 - protein, 6 aa, Homo Sapien
QGISSW

SEQ ID NO: 289 - protein, 3 aa, Homo Sapien
AAS

SEQ ID NO: 290 - protein, 9 aa, Homo Sapien
QQANSFPFT

SEQ ID NO: 291 - protein, 11 aa, Homo Sapien
RASQGISSWLA

SEQ ID NO: 292 - protein, 7 aa, Homo Sapien
AASSLQS

SEQ ID NO: 293 - protein, 9 aa, Homo Sapien
QQANSFPFT

SEQ ID NO: 294 - protein, 107 aa, Homo Sapien
DIQMTQSPSSVSASVGDRVTITCRASQGISSWLAWYQQKPGKAPKLLIYAASSLQSGVPSRFSGSGSGTDFTLTISSLQPEDFATYYCQQANSFPFTFGPGTKVDIK

SEQ ID NO: 295 - DNA, 322 bp, Homo Sapien
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttcccattcactttcggccctgggaccaaagtggatatcaaac

SEQ ID NO: 296 - protein, 214 aa, Homo Sapien
DIQMTQSPSSVSASVGDRVTITCRASQGISSWLAWYQQKPGKAPKLLIYAASSLQSGVPSRFSGSGSGTDFTLTISSLQPEDFATYYCQQANSFPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 297 - DNA, 642 bp, Homo Sapien
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttcccattcactttcggccctgggaccaaagtggatatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 298 - protein, 214 aa, Homo Sapien
DIQMTQSPSSLSASVGDRVTITCRASQSISSYLNWYQQKPGKAPKLLIYYASSLQSGVPSRFSGSGSGTDFTLTISSLQPEDFATYYCQQSYSTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 299 - protein, 453 aa, Homo Sapien
EVQLVESGGGLVQPGRSLRLSCAASGFTFDDYAMHWVRQVPGKGLEWVSGISWIRTGIGYADSVKGRFTIFRDNAKNSLYLQMNSLRAEDTALYYCAKDMKGSGTYGGWFDTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 300 - protein, 347 aa, Homo Sapien
DIQMTQSPSSLSASVGDRVTITCRASQSISSYLNWYQQKPGKAPKLLIYVASSLQSGVPSRFSGSGSGTDFTLTISSLQPEDFATYYCQQSYSTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 301 - protein, 133 aa, Homo Sapien [sequence omitted]

SEQ ID NO: 302 - protein, 586 aa, Homo Sapien
EVQLVESGGGLVQPGRSLRLSCAASGFTFDDYAMHWVRQVPGKGLEWVSGISWIRTGIGYADSVKGRFTIFRDNAKNSLYLQMNSLRAEDTALYYCAKDMKGSGTYGGWFDTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 303 - protein, 14 aa, Homo Sapien
APTSTQLQLELLLD

SEQ ID NO: 304 - protein, 11 aa, Homo Sapien
TQLQLEHLLLD

SEQ ID NO: 305 - protein, 17 aa, Homo Sapien
APTSKKTQLQLEHLLLD

SEQ ID NO: 306 - protein, 19 aa, Homo Sapien
PTSSSTKKTQLQLEHLLLD

SEQ ID NO: 307 - protein, 18 aa, Homo Sapien
TSSSTKKTQLQLEHLLLD

SEQ ID NO: 308 - protein, 17 aa, Homo Sapien
SSSTKKTQLQLEHLLLD

SEQ ID NO: 309 - protein, 16 aa, Homo Sapien
SSTKKTQLQLEHLLLD

SEQ ID NO: 310 - protein, 15 aa, Homo Sapien
STKKTQLQLEHLLLD

SEQ ID NO: 311 - protein, 14 aa, Homo Sapien
TKKTQLQLEHLLLD

SEQ ID NO: 312 - protein, 13 aa, Homo Sapien
KKTQLQLEHLLLD

SEQ ID NO: 313 - protein, 12 aa, Homo Sapien
KTQLQLEHLLLD

SEQ ID NO: 314 - protein, 19 aa, Homo Sapien
APTSSSTKTQLQLEHLLLD

SEQ ID NO: 315 - protein, 18 aa, Homo Sapien
APTSSSTTQLQLEHLLLD

SEQ ID NO: 316 - protein, 17 aa, Homo Sapien
APTSSSTQLQLEHLLLD

SEQ ID NO: 317 - protein, 16 aa, Homo Sapien
APTSSTQLQLEHLLLD

SEQ ID NO: 318 - protein, 14 aa, Homo Sapien
APTTQLQLEHLLLD

SEQ ID NO: 319 - protein, 13 aa, Homo Sapien
APTQLQLEHLLLD

SEQ ID NO: 320 - protein, 12 aa, Homo Sapien
ATQLQLEHLLLD

SEQ ID NO: 321 - protein, 15 aa, Homo Sapien
ATKKTQLQLEHLLLD

SEQ ID NO: 322 - protein, 15 aa, Homo Sapien
APKKTQLQLEHLLLD

SEQ ID NO: 323 - protein, 15 aa, Homo Sapien
APTKTQLQLEHLLLD

SEQ ID NO: 324 - protein, 113 aa, Homo Sapien
LQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 325 - protein, 290 aa, Mus Musculus
MRIFAGIIFTACCHLLRAFTITAPKDLYVVEYGSNVTMECRFPVERELDLLALVVYWEKEDEQVIQFVAGEEDLKPQHSNFRGRASLPKDQLLKGNAALQITDVKLQDAGVYCCIISYGGADYKRITLKVNAPYRKINQRISVDPATSEHELICQAEGYPEAEVIWTNSDHQPVSGKRSVTTSRTEGMLLNVTSSLRVNATANDVFYCTFWRSQPGQNHTAELIIPELPATHPPQNRTHWVLLGSILLFLIVVSTVLLFLRKQVRMLDVEKCGVEDTSSKNRNDTQFEET

SEQ ID NO: 326 - protein, 226 aa, Mus Musculus
FTITAPKDLYVVEYGSNVTMECRFPVERELDLLALVVYWEKEDEQVIQFVAGEEDLKPQHSNFRGRASLPKDQLLKGNAALQITDVKLQDAGVYCCIISYGGADYKRITLKVNAPYRKINQRISVDPATSEHELICQAEGYPEAEVIWTNSDHQPVSGKRSVTTSRTEGMLLNVTSSLRVNATANDVFYCTFWRSQPGQNHTAELIIPELPATHPPQNRTHHHHHH

SEQ ID NO: 327 - protein, 251 aa, Homo Sapien
ELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 328 - protein, 525 aa, Homo Sapien
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 329 - protein, 347 aa, Homo Sapien
LNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 330 - protein, 152 aa, Homo Sapien
DCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEH

SEQ ID NO: 331 - protein, 133 aa, Homo Sapien
GIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 332 - protein, 133 aa, Homo Sapien [sequence omitted]

SEQ ID NO: 333 - protein, 127 aa, Homo Sapien [sequence omitted]

SEQ ID NO: 334 - protein, 171 aa, Homo Sapien
CDLPQNHGLLSRNTLVLLHQMRRISPFLCLKDRRDFRFPQEMVKGSQLQKAHVMSVLHEMLQQIFSLFHTERSSAAWNMTLLDQLHTELHQQLQHLETCLLQVVGEGESAGAISSPALTLRRYFQGIRVYLKEKKYSDCAWEVVRMEIMKSLFLSTNMQERLRSKDRDLGS

SEQ ID NO: 335 - protein, 177 aa, Homo Sapien
GPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 336 - protein, 197 aa, Homo Sapien
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 337 - protein, 306 aa, Homo Sapien
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 338 - protein, 103 aa, Homo Sapien
TPVVRKGRCSCISTNQGTIHLQSLKDLKQFAPSPSCEKIEIIATLKNGVQTCLNPDSADVKELIKKWEKQVSQKKKQKNGKKHQKKKVLKVRKSQRSRQKKTT

SEQ ID NO: 339 - protein, 77 aa, Homo Sapien
VPLSRTVRCTCISISNQPVNPRSLEKLEIIPASQFCPRVEIIATMKKKGEKRCLNPESKAIKNLLKAVSKERSKRSP

SEQ ID NO: 340 - protein, 330 aa, Homo Sapien [sequence omitted]

SEQ ID NO: 341 - DNA, 996 bp, Homo Sapien
gccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 342 - protein, 450 aa, Homo Sapien
EVQLVESGGGLVQPGRSLRLSCAASGFTFDDYAMHWVRQAPGKGLEWVSGISWIRTGIGYADSVKGRFTISRDNAKNSLYLQMNSLRAEDTALYYCAKDMKGSGTYGGWFDTWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPELAGAPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 343 - protein, 8 aa, Homo Sapien
GFTFSNYA

SEQ ID NO: 344 - protein, 8 aa, Homo Sapien
ISFSGGTT

SEQ ID NO: 345 - protein, 14 aa, Homo Sapien
AKDEAPAGATFFDS

SEQ ID NO: 346 - protein, 5 aa, Homo Sapien
NYAMS

SEQ ID NO: 347 - protein, 17 aa, Homo Sapien
AISFSGGTTYYADSVKG

SEQ ID NO: 348 - protein, 12 aa, Homo Sapien
DEAPAGATFFDS

SEQ ID NO: 349 - protein, 121 aa, Homo Sapien
EVQLAESGGGLVQPGGSLRLSCAASGFTFSNYAMSWVRQTPGKGLEWVSAISFSGGTTYYADSVKGRFTISRDNSKNTLYLHMNSLRADDTAVYYCAKDEAPAGATFFDSWGQGTLVTVSS

SEQ ID NO: 350 - DNA, 364 bp, Homo Sapien
gaagtgcaactggcggagtctgggggaggcttggtacagccgggggggtccctgagactctcctgtgcagcctctggattcacctttagcaactatgccatgagttgggtccgccagactccaggaaaggggctggagtgggtctcagctattagttttagtggtggtactacatactacgctgactccgtgaagggccggttcaccatctccagagacaattccaagaacacgctgtatttgcacatgaacagcctgagagccgatgacacggccgtatattactgtgcgaaagatgaggcaccagctggcgcaaccttctttgactcctggggccagggaacgctggtcaccgtctcctcag

SEQ ID NO: 351 - protein, 448 aa, Homo Sapien
EVQLAESGGGLVQPGGSLRLSCAASGFTFSNYAMSWVRQTPGKGLEWVSAISFSGGTTYYADSVKGRFTISRDNSKNTLYLHMNSLRADDTAVYYCAKDEAPAGATFFDSWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 352 - DNA, 1344 bp, Homo Sapien
gaagtgcaactggcggagtctgggggaggcttggtacagccgggggggtccctgagactctcctgtgcagcctctggattcacctttagcaactatgccatgagttgggtccgccagactccaggaaaggggctggagtgggtctcagctattagttttagtggtggtactacatactacgctgactccgtgaagggccggttcaccatctccagagacaattccaagaacacgctgtatttgcacatgaacagcctgagagccgatgacacggccgtatattactgtgcgaaagatgaggcaccagctggcgcaaccttctttgactcctggggccagggaacgctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 353 - protein, 6 aa, Homo Sapien
QGIRRW

SEQ ID NO: 354 - protein, 3 aa, Homo Sapien
GAS

SEQ ID NO: 355 - protein, 9 aa, Homo Sapien
QQANSFPIT

SEQ ID NO: 356 - protein, 11 aa, Homo Sapien
RASQGIRRWLA

SEQ ID NO: 357 - protein, 7 aa, Homo Sapien
GASSLQS

SEQ ID NO: 358 - protein, 9 aa, Homo Sapien
QQANSFPIT

SEQ ID NO: 359 - protein, 107 aa, Homo Sapien
DIQMTQSPSSVSASVGDRVTITCRASQGIRRWLAWYQQKPGKAPKLLISGASSLQSGVPSRFSGSGSGTDFTLIITSLQPEDFATYYCQQANSFPITFGQGTRLEIK

SEQ ID NO: 360 - DNA, 322 bp, Homo Sapien
gacatccagatgacccagtctccatcttccgtgtctgcatctgtaggagacagagtcaccatcacttgtcgggcgagtcagggtattaggaggtggttagcctggtatcagcagaaaccagggaaagcccctaaactcctgatctctggtgcatccagtttgcaaagtggggtcccatcaaggttcagcggcagtggatctgggacagatttcactctcatcattaccagtctgcagcctgaagattttgcaacttactattgtcaacaggctaacagtttcccgatcaccttcggccaagggacacgactggagatcaaac

SEQ ID NO: 361 - protein, 214 aa, Homo Sapien
DIQMTQSPSSVSASVGDRVTITCRASQGIRRWLAWYQQKPGKAPKLLISGASSLQSGVPSRFSGSGSGTDFTLIITSLQPEDFATYYCQQANSFPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 362 - DNA, 642 bp, Homo Sapien
gacatccagatgacccagtctccatcttccgtgtctgcatctgtaggagacagagtcaccatcacttgtcgggcgagtcagggtattaggaggtggttagcctggtatcagcagaaaccagggaaagcccctaaactcctgatctctggtgcatccagtttgcaaagtggggtcccatcaaggttcagcggcagtggatctgggacagatttcactctcatcattaccagtctgcagcctgaagattttgcaacttactattgtcaacaggctaacagtttcccgatcaccttcggccaagggacacgactggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 363 - protein, 8 aa, Homo Sapien
GYTFSTFG

SEQ ID NO: 364 - protein, 8 aa, Homo Sapien
ISAYNGDT

SEQ ID NO: 365 - protein, 14 aa, Homo Sapien
ARSSGHYYYYGMDV

SEQ ID NO: 366 - protein, 121 aa, Homo Sapien
QVQVVQSGAEVKKPGASVKVSCKASGYTFSTFGITWVRQAPGQGLEWMGWISAYNGDTNYAQNLQGRVIMTTDTSTSTAYMELRSLRSDDTAVYYCARSSGHYYYYGMDVWGQGTTVTVSS

SEQ ID NO: 367 - DNA, 363 bp, Homo Sapien
caggttcaggtggtgcagtctggagctgaggtgaagaagcctggggcctcagtgaaggtctcctgcaaggcttctggttacaccttttccacctttggtatcacctgggtgcgacaggcccctggacaagggcttgaatggatgggatggatcagcgcttacaatggtgacacaaactatgcacagaatctccagggcagagtcatcatgaccacagacacatccacgagcacagcctacatggagctgaggagcctgagatctgacgacacggccgtttattactgtgcgaggagcagtggccactactactactacggtatggacgtctggggccaagggaccacggtcaccgtctcctca

SEQ ID NO: 368 - protein, 451 aa, Homo Sapien
QVQVVQSGAEVKKPGASVKVSCKASGYTFSTFGITWVRQAPGQGLEWMGWISAYNGDTNYAQNLQGRVIMTTDTSTSTAYMELRSLRSDDTAVYYCARSSGHYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 369 - DNA, 1359 bp, Homo Sapien
caggttcaggtggtgcagtctggagctgaggtgaagaagcctggggcctcagtgaaggtctcctgcaaggcttctggttacaccttttccacctttggtatcacctgggtgcgacaggcccctggacaagggcttgaatggatgggatggatcagcgcttacaatggtgacacaaactatgcacagaatctccagggcagagtcatcatgaccacagacacatccacgagcacagcctacatggagctgaggagcctgagatctgacgacacggccgtttattactgtgcgaggagcagtggccactactactactacggtatggacgtctggggccaagggaccacggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 370 - protein, 11 aa, Homo Sapien
QSLLHSNEYNY

SEQ ID NO: 371 - protein, 3 aa, Homo Sapien
LGS

SEQ ID NO: 372 - protein, 9 aa, Homo Sapien
MQSLQTPLT

SEQ ID NO: 373 - protein, 112 aa, Homo Sapien
DIVMTQSPLSLPVTPGEPASISCRSSQSLLHSNEYNYLDWYLQKPGQSPQLLIFLGSNRASGVPDRFSGSGSGTDFTLKITRVEAEDVGIYYCMQSLQTPLTFGGGTKVEIK

SEQ ID NO: 374 - DNA, 336 bp, Homo Sapien
gatattgtgatgactcagtctccactctccctgcccgtcacccctggagagccggcctccatctcctgcaggtctagtcagagcctcctgcatagtaatgaatacaactatttggattggtacctgcagaagccagggcagtctccacagctcctgatctttttgggttctaatcgggcctccggggtccctgacaggttcagtggcagtggatcaggcacagattttacactgaaaatcaccagagtggaggctgaggatgttggaatttattactgcatgcaatctctacaaactccgctcactttcggcggagggaccaaggtggagatcaaa

SEQ ID NO: 375 - protein, 219 aa, Homo Sapien
DIVMTQSPLSLPVTPGEPASISCRSSQSLLHSNEYNYLDWYLQKPGQSPQLLIFLGSNRASGVPDRFSGSGSGTDFTLKITRVEAEDVGIYYCMQSLQTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 376 - DNA, 657 bp, Homo Sapien
gatattgtgatgactcagtctccactctccctgcccgtcacccctggagagccggcctccatctcctgcaggtctagtcagagcctcctgcatagtaatgaatacaactatttggattggtacctgcagaagccagggcagtctccacagctcctgatctttttgggttctaatcgggcctccggggtccctgacaggttcagtggcagtggatcaggcacagattttacactgaaaatcaccagagtggaggctgaggatgttggaatttattactgcatgcaatctctacaaactccgctcactttcggcggagggaccaaggtggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 377 - protein, 8 aa, Homo Sapien
GYTFTSYG

SEQ ID NO: 378 - protein, 8 aa, Homo Sapien
ISAYNGNT

SEQ ID NO: 379 - protein, 17 aa, Homo Sapien
ARSTYFYGSGTLYGMDV

SEQ ID NO: 380 - protein, 124 aa, Homo Sapien
QVQLVQSGGEVKKPGASVKVSCKASGYTFTSYGFSWVRQAPGQGLEWMGWISAYNGNTNYAQKLQGRVTMTTDTSTSTAYMELRSLRSDDTAVYYCARSTYFYGSGTLYGMDVWGQGTTVTVSS

SEQ ID NO: 381 - DNA, 372 bp, Homo Sapien
caggttcaactggtgcagtctggaggtgaggtgaagaagcctggggcctcagtgaaggtctcctgcaaggcttctggttacacctttaccagctatggtttcagctgggtgcgacaggcccctggacaaggactagagtggatgggatggatcagcgcttacaatggtaacacaaactatgcacagaagctccagggcagagtcaccatgaccacagacacatccacgagcacagcctacatggagctgaggagcttgagatctgacgacacggccgtgtattactgtgcgagatctacgtatttctatggttcggggaccctctacggtatggacgtctggggccaagggaccacggtcaccgtctcctca

SEQ ID NO: 382 - protein, 454 aa, Homo Sapien
QVQLVQSGGEVKKPGASVKVSCKASGYTFTSYGFSWVRQAPGQGLEWMGWISAYNGNTNYAQKLQGRVTMTTDTSTSTAYMELRSLRSDDTAVYYCARSTYFYGSGTLYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 383 - DNA, 1368 bp, Homo Sapien
caggttcaactggtgcagtctggaggtgaggtgaagaagcctggggcctcagtgaaggtctcctgcaaggcttctggttacacctttaccagctatggtttcagctgggtgcgacaggcccctggacaaggactagagtggatgggatggatcagcgcttacaatggtaacacaaactatgcacagaagctccagggcagagtcaccatgaccacagacacatccacgagcacagcctacatggagctgaggagcttgagatctgacgacacggccgtgtattactgtgcgagatctacgtatttctatggttcggggaccctctacggtatggacgtctggggccaagggaccacggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 384 - protein, 11 aa, Homo Sapien
QSLLHSDGYNY

SEQ ID NO: 385 - protein, 3 aa, Homo Sapien
LGS

SEQ ID NO: 386 - protein, 9 aa, Homo Sapien
MQALQTPLS

SEQ ID NO: 387 - protein, 112 aa, Homo Sapien
DIVMTQSPLSLPVTPGEPASISCRSSQSLLHSDGYNYLDWYLQKPGQSPQLLIYLGSTRASGFPDRFSGSGSGTDFTLKISRVEAEDVGVYYCMQALQTPLSFGQGTKLEIK

SEQ ID NO: 388 - DNA, 336 bp, Homo Sapien
gatattgtgatgactcagtctccactctccctgcccgtcacccctggagagccggcctccatctcctgcaggtctagtcagagcctcctgcatagtgatggatacaactgtttggattggtacctgcagaagccagggcagtctccacagctcctgatctatttgggttctactcgggcctccgggttccctgacaggttcagtggcagtggatcaggcacagattttacactgaaaatcagcagagtggaggctgaggatgttggggtttattactgcatgcaagctctacaaactccgtgcagttttggccaggggaccaagctggagatcaaa

SEQ ID NO: 389 - protein, 219 aa, Homo Sapien
DIVMTQSPLSLPVTPGEPASISCRSSQSLLHSDGYNYLDWYLQKPGQSPQLLIYLGSTRASGFPDRFSGSGSGTDFTLKISRVEAEDVGVYYCMQALQTPLSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 390 - DNA, 657 bp, Homo Sapien
gatattgtgatgactcagtctccactctccctgcccgtcacccctggagagccggcctccatctcctgcaggtctagtcagagcctcctgcatagtgatggatacaactgtttggattggtacctgcagaagccagggcagtctccacagctcctgatctatttgggttctactcgggcctccgggttccctgacaggttcagtggcagtggatcaggcacagattttacactgaaaatcagcagagtggaggctgaggatgttggggtttattactgcatgcaagctctacaaactccgtgcagttttggccaggggaccaagctggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 391 - protein, 8 aa, Homo Sapien
GYTFTSYG

SEQ ID NO: 392 - protein, 8 aa, Homo Sapien
ISAYNGNT

SEQ ID NO: 393 - protein, 17 aa, Homo Sapien
ARSTYFYGSGTLYGMDV

SEQ ID NO: 394 - protein, 124 aa, Homo Sapien; identical to SEQ ID NO: 380

SEQ ID NO: 395 - DNA, 372 bp, Homo Sapien; identical to SEQ ID NO: 381

SEQ ID NO: 396 - protein, 454 aa, Homo Sapien; identical to SEQ ID NO: 382

SEQ ID NO: 397 - DNA, 1368 bp, Homo Sapien; identical to SEQ ID NO: 383

SEQ ID NO: 398 - protein, 11 aa, Homo Sapien
QSLLHSDGYNC

SEQ ID NO: 399 - protein, 3 aa, Homo Sapien
LGS

SEQ ID NO: 400 - protein, 9 aa, Homo Sapien
MQALQTPCS

SEQ ID NO: 401 - protein, 112 aa, Homo Sapien
DIVMTQSPLSLPVTPGEPASISCRSSQSLLHSDGYNCLDWYLQKPGQSPQLLIYLGSTRASGFPDRFSGSGSGTDFTLKISRVEAEDVGVYYCMQALQTPCSFGQGTKLEIK

SEQ ID NO: 402 - DNA, 336 bp, Homo Sapien; identical to SEQ ID NO: 388

SEQ ID NO: 403 - protein, 219 aa, Homo Sapien
DIVMTQSPLSLPVTPGEPASISCRSSQSLLHSDGYNCLDWYLQKPGQSPQLLIYLGSTRASGFPDRFSGSGSGTDFTLKISRVEAEDVGVYYCMQALQTPCSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 404 - DNA, 657 bp, Homo Sapien; identical to SEQ ID NO: 390

SEQ ID NO: 405 - protein, 8 aa, Homo Sapien
GVTFDDYG

SEQ ID NO: 406 - protein, 8 aa, Homo Sapien
INWNGGDT

SEQ ID NO: 407 - protein, 17 aa, Homo Sapien
ARDFYGSGSYYHVPFDY

SEQ ID NO: 408 - protein, 124 aa, Homo Sapien
EVQLVESGGGVVRPGGSLRLSCVASGVTFDDYGMSWVRQAPGKGLEWVSGINWNGGDTDYSDSVKGRFTISRDNAKNSLYLQMNSLRAEDTALYYCARDFYGSGSYYHVPFDYWGQGILVTVSS

SEQ ID NO: 409 - DNA, 372 bp, Homo Sapien
gaggtgcagctggtggagtctgggggaggtgtggtacggcctggggggtccctgagactctcctgtgtagcctctggagtcacctttgatgattatggcatgagctgggtccgccaagctccagggaaggggctggartgggtctctggtattaattggaatggtggcgacacagattattcagactctgtgaagggccgattcaccatctccagagacaacgccaagaactccctgtatctacaaatgaatagtctgagagccgaggacacggccttgtattactgtgcgagggatttctatggttcggggagttattatcacgttccttttgactactggggccagggaatcctggtcaccgtctcctca

SEQ ID NO: 410 - protein, 454 aa, Homo Sapien
EVQLVESGGGVVRPGGSLRLSCVASGVTFDDYGMSWVRQAPGKGLEWVSGINWNGGDTDYSDSVKGRFTISRDNAKNSLYLQMNSLRAEDTALYYCARDFYGSGSYYHVPFDYWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 411 - DNA, 1368 bp, Homo Sapien
gaggtgcagctggtggagtctgggggaggtgtggtacggcctggggggtccctgagactctcctgtgtagcctctggagtcacctttgatgattatggcatgagctgggtccgccaagctccagggaaggggctggartgggtctctggtattaattggaatggtggcgacacagattattcagactctgtgaagggccgattcaccatctccagagacaacgccaagaactccctgtatctacaaatgaatagtctgagagccgaggacacggccttgtattactgtgcgagggatttctatggttcggggagttattatcacgttccttttgactactggggccagggaatcctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 412 - protein, 7 aa, Homo Sapien
QSVSRSY

SEQ ID NO: 413 - protein, 3 aa, Homo Sapien
GAS

SEQ ID NO: 414 - protein, 9 aa, Homo Sapien
HQYDMSPFT

SEQ ID NO: 415 - protein, 108 aa, Homo Sapien
EIVLTQSPGTLSLSPGERATLSCRASQSVSRSYLAWYQQKRGQAPRLLIYGASSRATGIPDRFSGDGSGTDFTLSISRLEPEDFAVYYCHQYDMSPFTFGPGTKVDIK

SEQ ID NO: 416 - DNA, 324 bp, Homo Sapien
gaaattgtgttgacgcagtctccagggaccctgtctttgtctccaggggaaagagccaccctctcctgcagggccagtcagagtgttagcagaagctacttagcctggtaccagcagaaacgtggccaggctcccaggctcctcatctatggtgcatccagcagggccactggcatcccagacaggttcagtggcgatgggtctgggacagacttcactctctccatcagcagactggagcctgaagattttgcagtgtattactgtcaccagtatgatatgtcaccattcactttcggccctgggaccaaagtggatatcaaa

SEQ ID NO: 417 - protein, 215 aa, Homo Sapien
EIVLTQSPGTLSLSPGERATLSCRASQSVSRSYLAWYQQKRGQAPRLLIYGASSRATGIPDRFSGDGSGTDFTLSISRLEPEDFAVYYCHQYDMSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 418 - DNA, 645 bp, Homo Sapien
gaaattgtgttgacgcagtctccagggaccctgtctttgtctccaggggaaagagccaccctctcctgcagggccagtcagagtgttagcagaagctacttagcctggtaccagcagaaacgtggccaggctcccaggctcctcatctatggtgcatccagcagggccactggcatcccagacaggttcagtggcgatgggtctgggacagacttcactctctccatcagcagactggagcctgaagattttgcagtgtattactgtcaccagtatgatatgtcaccattcactttcggccctgggaccaaagtggatatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 419 - protein, 8 aa, Homo Sapien
GLTFDDYG

SEQ ID NO: 420 - protein, 8 aa, Homo Sapien
INWNGDNT

SEQ ID NO: 421 - protein, 17 aa, Homo Sapien
ARDYYGSGSYYNVPFDY

SEQ ID NO: 422 - protein, 124 aa, Homo Sapien
EVQLVESGGGVVRPGGSLRLSCAASGLTFDDYGMSWVRQVPGKGLEWVSGINWNGDNTDYADSVKGRFTISRDNAKNSLYLQMNSLRAEDTALYYCARDYYGSGSYYNVPFDYWGQGTLVTVSS

SEQ ID NO: 423 - DNA, 372 bp, Homo Sapien
gaggtgcagctggtggagtctgggggaggtgtggtacggcctggggggtccctgagactctcctgtgcagcctctggactcacctttgatgattatggcatgagctgggtccgccaagttccagggaaggggctggagtgggtctctggtattaattggaatggtgataacacagattatgcagactctgtgaagggccgattcaccatctccagagacaacgccaagaactccctgtatctgcaaatgaacagtctgagagccgaggacacggccttgtattactgtgcgagggattactatggttcggggagttattataacgttccttttgactactggggccagggaaccctggtcaccgtctcctca

SEQ ID NO: 424 - protein, 454 aa, Homo Sapien
EVQLVESGGGVVRPGGSLRLSCAASGLTFDDYGMSWVRQVPGKGLEWVSGINWNGDNTDYADSVKGRFTISRDNAKNSLYLQMNSLRAEDTALYYCARDYYGSGSYYNVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 425 - DNA, 1368 bp, Homo Sapien
gaggtgcagctggtggagtctgggggaggtgtggtacggcctggggggtccctgagactctcctgtgcagcctctggactcacctttgatgattatggcatgagctgggtccgccaagttccagggaaggggctggagtgggtctctggtattaattggaatggtgataacacagattatgcagactctgtgaagggccgattcaccatctccagagacaacgccaagaactccctgtatctgcaaatgaacagtctgagagccgaggacacggccttgtattactgtgcgagggattactatggttcggggagttattataacgttccttttgactactggggccagggaaccctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 426 - protein, 7 aa, Homo Sapien
QSVSSSY

SEQ ID NO: 427 - protein, 3 aa, Homo Sapien
GAS

SEQ ID NO: 428 - protein, 8 aa, Homo Sapien
QQYGSSPF

SEQ ID NO: 429 - protein, 107 aa, Homo Sapien
EIVLTQSPGTLSLSPGERATLSCRASQSVSSSYLAWYQQKPGQAPRLLIYGASSRATGIPDRFSGSGSGTDFTLTIRRLEPEDFAVYYCQQYGSSPFFGPGTKVDIK

SEQ ID NO: 430 - DNA, 321 bp, Homo Sapien
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatatatggtgcatccagcagggccactggcatcccagacaggttcagtggcagtgggtctgggacagacttcactctcaccatcagaagactggagcctgaagattttgcagtgtattactgtcagcagtatggtagttcaccattcttcggccctgggaccaaagtggatatcaaa

SEQ ID NO: 431 - DNA, 323 bp, Homo Sapien
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatatatggtgcatccagcagggccactggcatcccagacaggttcagtggcagtgggtctgggacagacttcactctcaccatcagaagactggagcctgaagattttgcagtgtattactgtcagcagtatggtagttcaccattcacttcggccctgggaccaaagtggatatcaaa

SEQ ID NO: 432 - protein, 214 aa, Homo Sapien
EIVLTQSPGTLSLSPGERATLSCRASQSVSSSYLAWYQQKPGQAPRLLIYGASSRATGIPDRFSGSGSGTDFTLTIRRLEPEDFAVYYCQQYGSSPFFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 433 - DNA, 642 bp, Homo Sapien
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatatatggtgcatccagcagggccactggcatcccagacaggttcagtggcagtgggtctgggacagacttcactctcaccatcagaagactggagcctgaagattttgcagtgtattactgtcagcagtatggtagttcaccattcttcggccctgggaccaaagtggatatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 434 - DNA, 644 bp, Homo Sapien
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatatatggtgcatccagcagggccactggcatcccagacaggttcagtggcagtgggtctgggacagacttcactctcaccatcagaagactggagcctgaagattttgcagtgtattactgtcagcagtatggtagttcaccattcacttcggccctgggaccaaagtggatatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 435 - protein, 8 aa, Homo Sapien
GYTFNSYG

SEQ ID NO: 436 - protein, 8 aa, Homo Sapien
ISVHNGNT

SEQ ID NO: 437 - protein, 17 aa, Homo Sapien
ARAGYDILTDFSDAFDI

SEQ ID NO: 438 - protein, 124 aa, Homo Sapien
QVQLVQSGAEVKKPGASVKVSCKASGYTFNSYGIIWVRQAPGQGLEWMGWISVHNGNTNCAQKLQGRVTMTTDTSTSTAYMELRSLRTDDTAVYYCARAGYDILTDFSDAFDIWGHGTMVTVSS

SEQ ID NO: 439 - DNA, 372 bp, Homo Sapien
caggttcagttggtgcagtctggagctgaggtgaagaagcctggggcctcagtgaaggtctcctgcaaggcttctggttacacctttaatagttatggtatcatctgggtgcgacaggcccctggacaagggcttgagtggatgggatggatcagcgttcacaatggtaacacaaactgtgcacagaagctccagggtagagtcaccatgaccacagacacatccacgagcacagcctacatggagctgaggagcctgagaactgacgacacggccgtgtattactgtgcgagagcgggttacgatattttgactgatttttccgatgcttttgatatctggggccacgggacaatggtcaccgtctcttca

SEQ ID NO: 440 - protein, 454 aa, Homo Sapien
QVQLVQSGAEVKKPGASVKVSCKASGYTFNSYGIIWVRQAPGQGLEWMGWISVHNGNTNCAQKLQGRVTMTTDTSTSTAYMELRSLRTDDTAVYYCARAGYDILTDFSDAFDIWGHGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 441 - DNA, 1368 bp, Homo Sapien
caggttcagttggtgcagtctggagctgaggtgaagaagcctggggcctcagtgaaggtctcctgcaaggcttctggttacacctttaatagttatggtatcatctgggtgcgacaggcccctggacaagggcttgagtggatgggatggatcagcgttcacaatggtaacacaaactgtgcacagaagctccagggtagagtcaccatgaccacagacacatccacgagcacagcctacatggagctgaggagcctgagaactgacgacacggccgtgtattactgtgcgagagcgggttacgatattttgactgatttttccgatgcttttgatatctggggccacgggacaatggtcaccgtctcttcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 442 - protein, 6 aa, Homo Sapien
QNINNF

SEQ ID NO: 443 - protein, 3 aa, Homo Sapien
AAS

SEQ ID NO: 444 - protein, 8 aa, Homo Sapien
QQSYGIPW

SEQ ID NO: 445 - protein, 106 aa, Homo Sapien
DIQMTQSPSSLSASVGDRVTITCRASQNINNFLNWYQQKEGKGPKLLIYAASSLQRGIPSTFSGSGSGTDFTLTISSLQPEDFATYICQQSYGIPWVGQGTKVEIK

SEQ ID NO: 446 - DNA, 318 bp, Homo Sapien
gacatccagatgacccagtctccatcctccctgtctgcatctgtaggagacagagtcaccatcacttgccgggcaagtcagaacattaataactttttaaattggtatcagcagaaagaagggaaaggccctaagctcctgatctatgcagcatccagtttgcaaagagggataccatcaacgttcagtggcagtggatctgggacagacttcactctcaccatcagcagtctgcaacctgaagattttgcaacttacatctgtcaacagagctacggtatcccgtgggtcggccaagggaccaaggtggaaatcaaa

SEQ ID NO: 447 - protein, 213 aa, Homo Sapien
DIQMTQSPSSLSASVGDRVTITCRASQNINNFLNWYQQKEGKGPKLLIYAASSLQRGIPSTFSGSGSGTDFTLTISSLQPEDFATYICQQSYGIPWVGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 448 - DNA, 639 bp, Homo Sapien
gacatccagatgacccagtctccatcctccctgtctgcatctgtaggagacagagtcaccatcacttgccgggcaagtcagaacattaataactttttaaattggtatcagcagaaagaagggaaaggccctaagctcctgatctatgcagcatccagtttgcaaagagggataccatcaacgttcagtggcagtggatctgggacagacttcactctcaccatcagcagtctgcaacctgaagattttgcaacttacatctgtcaacagagctacggtatcccgtgggtcggccaagggaccaaggtggaaatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 449 - protein, 8 aa, Homo Sapien
GFTFSDYF

SEQ ID NO: 450 - protein, 8 aa, Homo Sapien
ISSSGSTI

SEQ ID NO: 451 - protein, 21 aa, Homo Sapien
ARDHYDGSGIYPLYYYYGLDV

SEQ ID NO: 452 - protein, 128 aa, Homo Sapien
QVQLVESGGGLVKPGGSLRLSCAASGFTFSDYFMSWIRQAPGKGLEWISYISSSGSTIYYADSVRGRFTISRDNAKYSLYLQMNSLRSEDTAVYYCARDHYDGSGIYPLYYYYGLDVWGQGTTVTVSS

SEQ ID NO: 453 - DNA, 384 bp, Homo Sapien
caggtgcagctggtggagtctgggggaggcttggtcaagcctggagggtccctgagactctcctgtgcagcctctggattcaccttcagtgactacttcatgagctggatccgccaggcgccagggaaggggctggagtggatttcatacattagttctagtggtagtaccatatactacgcagactctgtgaggggccgattcaccatctccagggacaacgccaagtactcactgtatctgcaaatgaacagcctgagatccgaggacacggccgtgtattactgtgcgagagatcactacgatggttcggggatttatcccctctactactattacggtttggacgtctggggccaggggaccacggtcaccgtctcctca

SEQ ID NO: 454 - protein, 458 aa, Homo Sapien
QVQLVESGGGLVKPGGSLRLSCAASGFTFSDYFMSWIRQAPGKGLEWISYISSSGSTIYYADSVRGRFTISRDNAKYSLYLQMNSLRSEDTAVYYCARDHYDGSGIYPLYYYYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 455 - DNA, 1380 bp, Homo Sapien
caggtgcagctggtggagtctgggggaggcttggtcaagcctggagggtccctgagactctcctgtgcagcctctggattcaccttcagtgactacttcatgagctggatccgccaggcgccagggaaggggctggagtggatttcatacattagttctagtggtagtaccatatactacgcagactctgtgaggggccgattcaccatctccagggacaacgccaagtactcactgtatctgcaaatgaacagcctgagatccgaggacacggccgtgtattactgtgcgagagatcactacgatggttcggggatttatcccctctactactattacggtttggacgtctggggccaggggaccacggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 456 - protein, 11 aa, Homo Sapien
QSLLHSNGYNY

SEQ ID NO: 457 - protein, 3 aa, Homo Sapien
LGS

SEQ ID NO: 458 - protein, 9 aa, Homo Sapien
MQALQTPRS

SEQ ID NO: 459 - protein, 111 aa, Homo Sapien
IVMTQSPLSLPVTPGEPASISCRSSQSLLHSNGYNYLDYYLQKPGQSPQLLIYLGSYRASGVPDRFSGSGSGTDFTLKISRVEAEDVGVYYCMQALQTPRSFGQGTTLEIK

SEQ ID NO: 460 - DNA, 333 bp, Homo Sapien
attgtgatgactcagtctccactctccctacccgtcacccctggagagccggcctccatctcctgcaggtctagtcagagcctcctgcatagtaatggatacaactatttggattattacctgcagaagccagggcagtctccacagctcctgatctatttgggttcttatcgggcctccggggtccctgacaggttcagtggcagtggatcaggcacagattttacactgaaaatcagcagagtggaggctgaggatgttggggtttattactgcatgcaagctctacaaactcctcgcagttttggccaggggaccacgctggagatcaaa

SEQ ID NO: 461 - protein, 218 aa, Homo Sapien
IVMTQSPLSLPVTPGEPASISCRSSQSLLHSNGYNYLDYYLQKPGQSPQLLIYLGSYRASGVPDRFSGSGSGTDFTLKISRVEAEDVGVYYCMQALQTPRSFGQGTTLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 462 - DNA, 654 bp, Homo Sapien
attgtgatgactcagtctccactctccctacccgtcacccctggagagccggcctccatctcctgcaggtctagtcagagcctcctgcatagtaatggatacaactatttggattattacctgcagaagccagggcagtctccacagctcctgatctatttgggttcttatcgggcctccggggtccctgacaggttcagtggcagtggatcaggcacagattttacactgaaaatcagcagagtggaggctgaggatgttggggtttattactgcatgcaagctctacaaactcctcgcagttttggccaggggaccacgctggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 463 - protein, 10 aa, Homo Sapien
GFSLSTTGVG

SEQ ID NO: 464 - protein, 7 aa, Homo Sapien
IYWDDDK

SEQ ID NO: 465 - protein, 16 aa, Homo Sapien
THGYGSASYYHYGMDV

SEQ ID NO: 466 - protein, 124 aa, Homo Sapien
QITLKESGPTLVKPTQTLTLTCTFSGFSLSTTGVGVGWIRQPPGKALEWLAVIYWDDDKRYSPSLKSRLTITKDTSKNQVVLTMTNMDPVDTATYFCTHGYGSASYYHYGMDVWGQGTTVTVSS

SEQ ID NO: 467 - DNA, 372 bp, Homo Sapien
cagatcaccttgaaggagtctggtcctacgctggtgaaacccacacagaccctcacgctgacctgcaccttctctgggttctcactcagcactactggagtgggtgtgggctggatccgtcagcccccaggaaaggccctggagtggcttgcagtcatttattgggatgatgataagcgctacagcccatctctgaagagcagactcaccatcaccaaggacacctccaaaaaccaggtggtccttacaatgaccaacatggaccctgtggacacagccacatatttctgtacacacggatatggttcggcgagttattaccactacggtatggacgtctggggccaagggaccacggtcaccgtctcctca

SEQ ID NO: 468 - protein, 454 aa, Homo Sapien
QITLKESGPTLVKPTQTLTLTCTFSGFSLSTTGVGVGWIRQPPGKALEWLAVIYWDDDKRYSPSLKSRLTITKDTSKNQVVLTMTNMDPVDTATYFCTHGYGSASYYHYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 469 - DNA, 1368 bp, Homo Sapien
cagatcaccttgaaggagtctggtcctacgctggtgaaacccacacagaccctcacgctgacctgcaccttctctgggttctcactcagcactactggagtgggtgtgggctggatccgtcagcccccaggaaaggccctggagtggcttgcagtcatttattgggatgatgataagcgctacagcccatctctgaagagcagactcaccatcaccaaggacacctccaaaaaccaggtggtccttacaatgaccaacatggaccctgtggacacagccacatatttctgtacacacggatatggttcggcgagttattaccactacggtatggacgtctggggccaagggaccacggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 470 - protein, 6 aa, Homo Sapien
QSVTNY

SEQ ID NO: 471 - protein, 3 aa, Homo Sapien
DAS

SEQ ID NO: 472 - protein, 9 aa, Homo Sapien
QHRSNWPLT

SEQ ID NO: 473 - protein, 107 aa, Homo Sapien
EIVLTQSPATLSLSPGERATLSCRASQSVTNYLAWHQQKPGQAPRLLIYDASNRATGIPARFSGSGSGTDFTLTISSLEPEDFAVYYCQHRSNWPLTFGGGTKVEIK

SEQ ID NO: 474 - DNA, 322 bp, Homo Sapien
gaaattgtattgacacagtctccagccaccctgtctttgtctccaggggaaagagccaccctctcctgcagggccagtcagagtgttaccaactacttagcctggcaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcaccgtagcaactggcctctcactttcggcggagggaccaaggtggagatcaaac

SEQ ID NO: 475 - protein, 214 aa, Homo Sapien
EIVLTQSPATLSLSPGERATLSCRASQSVTNYLAWHQQKPGQAPRLLIYDASNRATGIPARFSGSGSGTDFTLTISSLEPEDFAVYYCQHRSNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 476 - DNA, 643 bp, Homo Sapien
gaaattgtattgacacagtctccagccaccctgtctttgtctccaggggaaagagccaccctctcctgcagggccagtcagagtgttaccaactacttagcctggcaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcaccgtagcaactggcctctcactttcggcggagggaccaaggtggagatcaaaccgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 477 - protein, 10 aa, Homo Sapien
GFSLSTSGVG

SEQ ID NO: 478 - protein, 7 aa, Homo Sapien
IYWDDDK

SEQ ID NO: 479 - protein, 16 aa, Homo Sapien
THGYGSASYYHYGMDV

SEQ ID NO: 480 - protein, 124 aa, Homo Sapien
QITLKESGPTLVKPTQTLTLTCTFSGFSLSTSGVGVGWIRQPPGKALEWLAVIYWDDDKRYSPSLKSRLTITKDTSKNQVVLTMTNMDPVDTATYFCTHGYGSASYYHYGMDVWGQGTTVTVSS

SEQ ID NO: 481 - DNA, 372 bp, Homo Sapien
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcagtcatttattgggatgatgataagcgctacagcccatctctgaagagcaggctcaccatcaccaaggacacctccaaaaaccaggtggtccttacaatgaccaacatggaccctgtggacacagccacatatttctgtacacacggatatggttcggcgagttattaccactacggtatggacgtctggggccaagggaccacggtcaccgtctcctca

SEQ ID NO: 482 - protein, 454 aa, Homo Sapien
QITLKESGPTLVKPTQTLTLTCTFSGFSLSTSGVGVGWIRQPPGKALEWLAVIYWDDDKRYSPSLKSRLTITKDTSKNQVVLTMTNMDPVDTATYFCTHGYGSASYYHYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 483 - DNA, 1368 bp, Homo Sapien
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcagtcatttattgggatgatgataagcgctacagcccatctctgaagagcaggctcaccatcaccaaggacacctccaaaaaccaggtggtccttacaatgaccaacatggaccctgtggacacagccacatatttctgtacacacggatatggttcggcgagttattaccactacggtatggacgtctggggccaagggaccacggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 484 - protein, 6 aa, Homo Sapien
QSVTNY

SEQ ID NO: 485 - protein, 3 aa, Homo Sapien
DAS

SEQ ID NO: 486 - protein, 9 aa, Homo Sapien
QQRSNWPLT

SEQ ID NO: 487 - protein, 107 aa, Homo Sapien
EIVLTQSPATLSLSPGERATLSCRASQSVTNYLAWHQQKPGQAPRLLIYDASNRATGIPARFSGSGSGTDFTLTISSLEPEDFAVYYCQQRSNWPLTFGGGTKVEIK

SEQ ID NO: 488 - DNA, 321 bp, Homo Sapien
gaaattgtgttgacacagtctccagccaccctgtctttgtctccaggggaaagagccaccctctcctgcagggccagtcagagtgttaccaactacttagcctggcaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaaa

SEQ ID NO: 489 - protein, 214 aa, Homo Sapien
EIVLTQSPATLSLSPGERATLSCRASQSVTNYLAWHQQKPGQAPRLLIYDASNRATGIPARFSGSGSGTDFTLTISSLEPEDFAVYYCQQRSNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 490 - DNA, 642 bp, Homo Sapien
gaaattgtgttgacacagtctccagccaccctgtctttgtctccaggggaaagagccaccctctcctgcagggccagtcagagtgttaccaactacttagcctggcaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 491 - protein, 8 aa, Homo Sapien
GFTFSDYY

SEQ ID NO: 492 - protein, 8 aa, Homo Sapien
ISSSGSTI

SEQ ID NO: 493 - protein, 20 aa, Homo Sapien
ARDFYDILTDSPYFYYGVDV

SEQ ID NO: 494 - protein, 127 aa, Homo Sapien
QVQLVESGGGLVKPGGSLRLSCAASGFTFSDYYMSWIRQAPGKGLEWVSYISSSGSTIYYADSVKGRFTISRDNAKNSLYLQINSLRAEDTAVYYCARDFYDILTDSPYFYYGVDVWGQGTTVTVSS

SEQ ID NO: 495 - DNA, 381 bp, Homo Sapien
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaattaacagcctgagagccgaggacacggccgtgtattactgtgcgagagatttttacgatattttgactgatagtccgtacttctactacggtgtggacgtctggggccaagggaccacggtcaccgtctcctca

SEQ ID NO: 496 - protein, 457 aa, Homo Sapien
QVQLVESGGGLVKPGGSLRLSCAASGFTFSDYYMSWIRQAPGKGLEWVSYISSSGSTIYYADSVKGRFTISRDNAKNSLYLQINSLRAEDTAVYYCARDFYDILTDSPYFYYGVDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 497 - DNA, 1377 bp, Homo Sapien
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaattaacagcctgagagccgaggacacggccgtgtattactgtgcgagagatttttacgatattttgactgatagtccgtacttctactacggtgtggacgtctggggccaagggaccacggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 498 - protein, 11 aa, Homo Sapien
QSLLHSNGYNY

SEQ ID NO: 499 - protein, 3 aa, Homo Sapien
LGS

SEQ ID NO: 500 - protein, 9 aa, Homo Sapien
MQALQTPRT

SEQ ID NO: 501 - protein, 112 aa, Homo Sapien
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKVEIK

SEQ ID NO: 502 - DNA, 336 bp, Homo Sapien
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcggacgttcggccaagggaccaaggtggaaatcaaa

SEQ ID NO: 503 - protein, 219 aa, Homo Sapien
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 504 - DNA, 657 bp, Homo Sapien
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcggacgttcggccaagggaccaaggtggaaatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 505 - protein, 239 aa, Homo Sapien
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTIEGRDYKDDDDKHHHHHH

SEQ ID NO: 506 - protein, 179 aa, Homo Sapien
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 507 - protein, 121 aa, Homo Sapien
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKF

SEQ ID NO: 508 - protein, 199 aa, Homo Sapien
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 509 - protein, 33 aa, Homo Sapien
KYSSSVHDPNGEYMFMRAVNTAKKSRLTDVTLM

SEQ ID NO: 510 - protein, 128 aa, Mus Musculus
EINGSADHRMFSFHNGGVQISCKYPETVQQLKMRLFREREVLCELTKTKGSGNAVSIKNPMLCLYHLSNNSVSFFLNNPDSSQGSYYFCSLSIFDPPPFQERNLSGGYLHIYESQLCCQLKIVVQVTE

SEQ ID NO: 511 - protein, 121 aa, Mus Musculus
EINGSADHRMFSFHNGGVQISCKYPETVQQLKMRLFREREVLCELTKTKGSGNAVSIKNPMLCLYHLSNNSVSFFLNNPDSSQGSYYFCSLSIFDPPPFQERNLSGGYLHIYESQLCCQLK

SEQ ID NO: 512 - protein, 147 aa, Mus Musculus
MGWSCIILFLVATATGVHSEINGSADHRMFSFHNGGVQISCKYPETVQQLKMRLFREREVLCELTKTKGSGNAVSIKNPMLCLYHLSNNSVSFFLNNPDSSQGSYYFCSLSIFDPPPFQERNLSGGYLHIYESQLCCQLKIVVQVTE

SEQ ID NO: 513 - protein, 199 aa, Cynomologus
MKSGLWYFFLFCLHMKVLTGEINGSANYEMFIFHNGGVQILCKYPDIVQQFKMQLLKGGQILCDLTKTKGSGNKVSIKSLKFCHSQLSNNSVSFFLYNLDRSHANYYFCNLSIFDPPPFKVTLTGGYLHIYESQLCCQLKFWLPIGCATFVVVCIFGCILICWLTKKKYSSTVHDPNGEYMFMRAVNTAKKSRLTGTTP

SEQ ID NO: 514 - protein, 120 aa, Cynomologus
EINGSANYEMFIFHNGGVQILCKYPDIVQQFKMQLLKGGQILCDLTKTKGSGNKVSIKSLKFCHSQLSNNSVSFFLYNLDRSHANYYFCNLSIFDPPPFKVTLTGGYLHIYESQLCCQLK

SEQ ID NO: 515 - protein, 240 aa, Homo Sapien
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWS

SEQ ID NO: 516 - protein, 302 aa, Homo Sapien
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 517 - protein, 113 aa, Homo Sapien
LQMILNGINNYKNPKLTAMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 518 - protein, 113 aa, Homo Sapien
LQMILNGINNYKNPKLTQMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 519 - DNA, 336 bp, Homo Sapien
gatattgtgatgactcagtctccactctccctgcccgtcacccctggagagccggcctccatctcctgcaggtctagtcagagcctcctgcatagtgatggatacaactatttggattggtacctgcagaagccagggcagtctccacagctcctgatctatttgggttctactcgggcctccgggttccctgacaggttcagtggcagtggatcaggcacagattttacactgaaaatcagcagagtggaggctgaggatgttggggtttattactgcatgcaagctctacaaactccgctcagttttggccaggggaccaagctggagatcaaa

SEQ ID NO: 520 - DNA, 657 bp, Homo Sapien
gatattgtgatgactcagtctccactctccctgcccgtcacccctggagagccggcctccatctcctgcaggtctagtcagagcctcctgcatagtgatggatacaactatttggattggtacctgcagaagccagggcagtctccacagctcctgatctatttgggttctactcgggcctccgggttccctgacaggttcagtggcagtggatcaggcacagattttacactgaaaatcagcagagtggaggctgaggatgttggggtttattactgcatgcaagctctacaaactccgctcagttttggccaggggaccaagctggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 521 - DNA, 372 bp, Homo Sapien
gaggtgcagctggtggagtctgggggaggtgtggtacggcctggggggtccctgagactctcctgtgtagcctctggagtcacctttgatgattatggcatgagctgggtccgccaagctccagggaaggggctggagtgggtctctggtattaattggaatggtggcgacacagattattcagactctgtgaagggccgattcaccatctccagagacaacgccaagaactccctgtatctacaaatgaatagtctgagagccgaggacacggccttgtattactgtgcgagggatttctatggttcggggagttattatcacgttccttttgactactggggccagggaatcctggtcaccgtctcctca

SEQ ID NO: 522 - DNA, 1368 bp, Homo Sapien
gaggtgcagctggtggagtctgggggaggtgtggtacggcctggggggtccctgagactctcctgtgtagcctctggagtcacctttgatgattatggcatgagctgggtccgccaagctccagggaaggggctggagtgggtctctggtattaattggaatggtggcgacacagattattcagactctgtgaagggccgattcaccatctccagagacaacgccaagaactccctgtatctacaaatgaatagtctgagagccgaggacacggccttgtattactgtgcgagggatttctatggttcggggagttattatcacgttccttttgactactggggccagggaatcctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 523 - DNA, 990 bp, Homo Sapien
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaa

SEQ ID NO: 524 - protein, 330 aa, Homo Sapien
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 525 - DNA, 990 bp, Homo Sapien
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacatcttctcatgctccgtgatgcatgaggctctgcacaaccactacacgcagaagagcctctccctgtctccgggtaaa

SEQ ID NO: 526 - protein, 330 aa, Homo Sapien
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNIFSCSVMHEALHNHYTQKSLSLSPGK

SEQ ID NO: 527 - DNA, 978 bp, Homo Sapien
gcctccaccaagggcccatcggtcttccccctggcgccctgctccaggagcacctccgagagcacagccgccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 528 - protein, 326 aa, Homo Sapien
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 529 - DNA, 978 bp, Homo Sapien
gcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgacctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcatggaggtgcataatgccaagacaaagccacgggaggagcagttcaacagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaa

SEQ ID NO: 530 - protein, 326 aa, Homo Sapien
ASTKGPSVFPLAPCSRSTSESTAALGCLVKDYFPEPVTVSWNSGALTSGVHTFPAVLQSSGLYSLSSVVTVTSSNFGTQTYTCNVDHKPSNTKVDKTVERKCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 531 - DNA, 978 bp, Homo Sapien
gcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcagcttgggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 532 - protein, 326 aa, Homo Sapien
ASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 533 - DNA, 978 bp, Homo Sapien
gcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatctccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaa

SEQ ID NO: 534 - protein, 326 aa, Homo Sapien
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 535 - DNA, 318 bp, Homo Sapien
ggtcagcccaaggctgccccctcggtcactctgttcccaccctcctctgaggagcttcaagccaacaaggccacactggtgtgtctcgtaagtgacttcaacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 536 - protein, 106 aa, Homo Sapien
GQPKAAPSVTLFPPSSEELQANKATLVCLVSDFNPGAVTVAWKADGSPVKVGVETTKPSKQSNNKYAASSYLSLTPEQWKSHRSYSCRVTHEGSTVEKTVAPAECS

SEQ ID NO: 537 - DNA, 990 bp, Homo Sapien
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 538 - protein, 106 aa, Homo Sapien; identical to SEQ ID NO: 225

SEQ ID NO: 539 - protein, 157 aa, Homo Sapien
MGWSCIILFLVATATGVHSMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPIEGRDYKDDDDKHHHHHH

SEQ ID NO: 540 - protein, 244 aa, Homo Sapien
MRWCLLLIWAQGLRQAPLASGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 541 - DNA, 2978 bp, Homo Sapien
cgtcctatctgcagtcggctactttcagtggcagaagaggccacatctgcttcctgtaggccctctgggcagaagcatgcgctggtgtctcctcctgatctgggcccaggggctgaggcaggctcccctcgcctcaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcagtggctgagcacggtgccaggttccagattccattgcttggagccatggccgcgacgctggtggtcatctgcacagcagtcatcgtggtggtcgcgttgactagaaagaagaaagccctcagaatccattctgtggaaggtgacctcaggagaaaatcagctggacaggaggaatggagccccagtgctccctcacccccaggaagctgtgtccaggcagaagctgcacctgctgggctctgtggagagcagcggggagaggactgtgccgagctgcatgactacttcaatgtcctgagttacagaagcctgggtaactgcagcttcttcacagagactggttagcaaccagaggcatcttctggaagatacacttttgtctttgctattatagatgaatatataagcagctgtactctccatcagtgctgcgtgtgtgtgtgtgtgtgtatgtgtgtgtgtgttcagttgagtgaataaatgtcatcctcttctccatcttcatttccttggccttttcgttctattccattttgcattatggcaggcctagggtgagtaacgtggatcttgatcataaatgcaaaattaaaaaatatcttgacctggttttaaatctggcagtttgagcagatcctatgtctctgagagacacattcctcataatggccagcattttgggctacaaggttttgtggttgatgatgaggatggcatgactgcagagccatcctcatctcattttttcacgtcattttcagtaactttcactcattcaaaggcaggttataagtaagtcctggtagcagcctctatggggagatttgagagtgactaaatcttggtatctgccctcaagaacttacagttaaatggggagacaatgttgtcatgaaaaggtattatagtaaggagagaaggagacatacacaggccttcaggaagagacgacagtttggggtgaggtagttggcataggcttatctgtgatgaagtggcctgggagcaccaaggggatgttgaggctagtctgggaggagcaggagttttgtctagggaacttgtaggaaattcttggagctgaaagtcccacaaagaaggccctggcaccaagggagtcagcaaacttcagattttattctctgggcaggcatttcaagtttccttttgctgtgacatactcatccattagacagcctgatacaggcctgtagcctcttccggccgtgtgtgctggggaagccccaggaaacgcacatgcccacacagggagccaagtcgtagcatttgggccttgatctaccttttctgcatcaatacactcttgagcctttgaaaaaagaacgtttcccactaaaaagaaaatgtggatttttaaaatagggactcttcctaggggaaaaaggggggctgggagtgatagagggtttaaaaaataaacaccttcaaactaacttcttcgaacccttttattcactccctgacgactttgtgctggggttggggtaactgaaccgcttatttctgtttaattgcattcaggctggatcttagaagacttttatccttccaccatctctctcagaggaatgagcggggaggttggatttactggtgactgattttctttcatgggccaaggaactgaaagagaatgtgaagcaaggttgtgtcttgcgcatggttaaaaataaagcattgtcctgcttcctaagacttagactggggttgacaattgttttagcaacaagacaattcaactatttctcctaggatttttattattattattttttcacttttctaccaaatgggttacataggaagaatgaactgaaatctgtccagagctccaagtcctttggaagaaagattagatgaacgtaaaaatgttgttgtttgctgtggcagtttacagcatttttcttgcaaaattagtgcaaatctgttggaaatagaacacaattcacaaattggaagtgaactaaaatgtaatgacgaaaagggagtagtgttttgatttggaggaggtgtatattcggcagaggttggactgagagttgggtgttatttaacataattatggtaattgggaaacatttataaacactattgggatggtgataaaatacaaaagggcctatagatgttagaaatgggtcaggttactgaaatgggattcaatttgaaaaaaatttttttaaatagaactcactgaactagattctcctctgagaaccagagaagaccatttcatagttggattcctggagacatgcgctatccaccacgtagccactttccacatgtggccatcaaccacttaagatggggttagtttaaatcaagatgtgctgttataattggtataagcataaaatcacactagattctggagatttaatatgaataataagaatactatttcagtagttttggtatattgtgtgtcaaaaatgataatattttggatgtattgggtgaaataaaatattaacattaaaaaaaaaaa

SEQ ID NO: 542 - DNA, 417 bp, Homo Sapien
atgggctggtcctgcatcatcctgtttctggtggccacagccaccggcgtgcacagcatgatgaccggcaccatcgagacaaccggcaacatcagcgccgagaagggcggctctatcatcctgcagtgccacctgagcagcaccaccgcccaagtgacccaagtgaactgggagcagcaggatcagctgctggccatctgcaacgccgatctgggctggcacatcagccccagcttcaaggacagagtggcccctggacctggcctgggactgacactgcagagcctgaccgtgaacgataccggcgagtacttctgcatctaccacacctaccccgacggcacctataccggccggatcttcctggaagtgctggaaagcagcgtggccgagcacggcgccagattccagatccct

SEQ ID NO: 543 - DNA, 732 bp, Homo Sapien
atgaggtggtgtctgctgctgatctgggctcagggcctgagacaggcccctctggctagcggaatgatgaccggcaccatcgagacaaccggcaacatcagcgccgagaagggcggcagcatcatcctgcagtgtcacctgagcagcaccaccgcacaagtgacccaagtgaactgggagcagcaggaccagctgctggccatctgtaacgctgacctgggctggcacatcagccccagcttcaaggacagagtggctcctggccctggcctgggactgactctgcagtctctgaccgtgaacgataccggcgagtacttctgcatctaccacacctaccccgacggcacctataccggcagaatcttcctggaagtgctggaaagcagcgtggccgagcacggcgccagattccagattcctctgctgggcgccatggccgccacactggtcgtgatctgtaccgccgtgatcgtggtggtggccctgaccagaaagaagaaggccctgcggatccacagcgtggaaggcgacctgagaagaaagtctgccggccaggaagagtggtcccctagcgctccaagccctcctggctcttgtgtgcaggctgaggctgctcctgctggcctgtgtggcgaacagagaggcgaggattgcgccgagctgcacgactacttcaacgtgctgagctacagaagcctgggcaactgcagcttcttcaccgagacaggc

SEQ ID NO: 544 - protein, 170 aa, Homo Sapien
MRWCLLLIWAQGLRQAPLASGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKFVCF

SEQ ID NO: 545 - protein, 375 aa, Homo Sapien
MGWSCIILFLVATATGVHSMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPIEGREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 546 - protein, 357 aa, Homo Sapien
MMTGTIETTGNISAEKGGSIILQCHLSSTTAQVTQVNWEQQDQLLAICNADLGWHISPSFKDRVAPGPGLGLTLQSLTVNDAGEYFCIYHTYPDGTYTGRIFLEVLESSVAEHGARFQIPIEGRMDPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 547 - protein, 244 aa, Cynomologus
MRWCLFLIWAQGLRQAPLASGMMTGTIETTGNISAKKGGSVILQCHLSSTMAQVTQVNWEQHDHSLLAIRNAELGWHIYPAFKDRVAPGPGLGLTLQSLTMNDTGEYFCTYHTYPDGTYRGRIFLEVLESSVAEHSARFQIPLLGAMAMMLVVICIAVIVVVVLARKKSLRIHSVESGLQRKSTGQEEQIPSAPSPPGSCVQAEAAPAGLCGEQQGDDCAELHDYFNVLSYRSLGSCSFFTETG

SEQ ID NO: 548 - DNA, 1259 bp, Cynomologus
ctcctgctgcaggatgttgcccttgttcgaggcagagacaggaggcctcagacagctgtgacagccctggagctctcctaccacatctgagccagagggaagactttggagaagcagaagcccaaagacactgctgggagattggtctgtgctctgggagaaccctaggttgtgtttcccgtgtacaagtcacggatcttctggaaggtaccaccgctcccagccccgcttggctgagggctgagggccacaggttttcgggactgtgcctgtggttggaggctgtggactcaagctcagttttaccgtcctatctgcagtcggctactttcggtggcagaagaggccacatctgcttcctgtaagccctctgggcagaagcatgcggtggtgtctcttcctgatctgggcccaggggctgaggcaggctcccctcgcctcaggaatgatgacaggcacaatagaaacaacggggaacatttctgcaaagaaaggtggctctgttatcttacaatgtcacctctcctccaccatggcacaagtgacccaggtcaactgggagcagcatgaccattcgcttctggccattcgtaatgctgagttggggtggcacatctacccagccttcaaggatcgagtggccccgggtcctggcctgggcctcaccctccagtcgctgaccatgaatgatacaggggagtacttctgcacctatcacacctaccctgatgggacttacagagggagaatcttcctggaggtcctagaaagctcagtggctgagcacagtgccaggttccagattccattgcttggagccatggccatgatgctggtggtcatctgcatagcagtcatcgtggtggtcgtgttggctagaaagaaatccctcagaatccattctgtggaaagtggcctccagagaaaatcaactggacaggaagaacagattcccagtgctccctcacccccaggaagctgtgtccaggcagaagctgcacctgctgggctctgtggagagcagcagggagatgactgtgccgagctgcatgactacttcaatgtcctgagttacagaagcctggggagctgcagcttcttcacagagactgggtagcaaacagaggcatgttctggaagatacacttttgtcttgactattatagatgtcttgactaatatataaacagctgtattcgccatcagtgtgcgcgcgcgtgtgtgttcagttgagtgaataaatgtcatcctcttctcta

SEQ ID NO: 549 - protein, 245 aa, Cynomologus
MRWCLFLIWAQGLRQAPLASGMMTGTIETTGNISAKKGGSVILQCHLSSTMAQVTQVNWEQHDHSLLAIRNAELGWHIYPAFKDRVAPGPGLGLTLQSLTMNDTGEYFCTYHTYPDGTYRGRIFLEVLESSVAEHSARFQIPLLGAMAMMLVVICIAVIVVVVLARKKKSLRIHSVESGLQRKSTGQEEQIPSAPSPPGSCVQAEAAPAGLCGEQQGDDCAELHDYFNVLSYRSLGSCSFFTETG

SEQ ID NO: 550 - DNA, 1260 bp, Cynomologus
cctgctgcaggatgttgcccttgttcgaggcagagacaggaggcctcagacagctgtgacagccctggagctctcctaccacatctgagccagagggaagactttggagaagcagaagcccaaagacactgctgggagattggtctgtgctctgggagaaccctaggttgtgtttcccgtgtacaagtcacggatcttctggaaggtaccaccgctcccagccccgcttggctgagggctgagggccacaggttttcgggactgtgcctgtggttggaggctgtggactcaagctcagttttaccgtcctatctgcagtcggctactttcggtggcagaagaggccacatctgcttcctgtaagccctctgggcagaagcatgcggtggtgtctcttcctgatctgggcccaggggctgaggcaggctcccctcgcctcaggaatgatgacaggcacaatagaaacaacggggaacatttctgcaaagaaaggtggctctgttatcttacaatgtcacctctcctccaccatggcacaagtgacccaggtcaactgggagcagcatgaccattcgcttctggccattcgtaatgctgagttggggtggcacatctacccagccttcaaggatcgagtggccccgggtcctggcctgggcctcaccctccagtcgctgaccatgaatgatacaggggagtacttctgcacctatcacacctaccctgatgggacttacagagggagaatcttcctggaggtcctagaaagctcagtggctgagcacagtgccaggttccagattccattgcttggagccatggccatgatgctggtggtcatctgcatagcagtcatcgtggtggtcgtgttggctagaaagaagaaatccctcagaatccattctgtggaaagtggcctccagagaaaatcaactggacaggaagaacagattcccagtgctccctcacccccaggaagctgtgtccaggcagaagctgcacctgctgggctctgtggagagcagcagggagatgactgtgccgagctgcatgactacttcaatgtcctgagttacagaagcctggggagctgcagcttcttcacagagactgggtagcaaacagaggcatgttctggaagatacacttttgtcttgactattatagatgtcttgactaatatataaacagctgtattcgccatcagtgtgcgcgcgcgtgtgtgttcagttgagtgaataaatgtcatcctcttctcta

SEQ ID NO: 551 - DNA, 1173 bp, Cynomologus
cctgctgcaggatgttgcccttgttcgaggcagagacaggaggcctcagacagctgtgacagccctggagctctcctaccacatctgagccagagggaagactttggagaagcagaagcccaaagacactgctgggagattggtctgtgctctgggagaaccctaggttgtgtttcccgtgtacaagtcacggatcttctggaaggctcagttttaccgtcctatctgcagtcggctactttcggtggcagaagaggccacatctgcttcctgtaagccctctgggcagaagcatgcggtggtgtctcttcctgatctgggcccaggggctgaggcaggctcccctcgcctcaggaatgatgacaggcacaatagaaacaacggggaacatttctgcaaagaaaggtggctctgttatcttacaatgtcacctctcctccaccatggcacaagtgacccaggtcaactgggagcagcatgaccattcgcttctggccattcgtaatgctgagttggggtggcacatctacccagccttcaaggatcgagtggccccgggtcctggcctgggcctcaccctccagtcgctgaccatgaatgatacaggggagtacttctgcacctatcacacctaccctgatgggacttacagagggagaatcttcctggaggtcctagaaagctcagtggctgagcacagtgccaggttccagattccattgcttggagccatggccatgatgctggtggtcatctgcatagcagtcatcgtggtggtcgtgttggctagaaagaagaaatccctcagaatccattctgtggaaagtggcctccagagaaaatcaactggacaggaagaacagattcccagtgctccctcacccccaggaagctgtgtccaggcagaagctgcacctgctgggctctgtggagagcagcagggagatgactgtgccgagctgcatgactacttcaatgtcctgagttacagaagcctggggagctgcagcttcttcacagagactgggtagcaaacagaggcatgttctggaagatacacttttgtcttgactattatagatgtcttgactaatatataaacagctgtattcgccatcagtgtgcgcgcgcgtgtgtgttcagttgagtgaataaatgtcatcctcttctcta

SEQ ID NO: 552 - DNA, 1273 bp, Cynomologus
tcctgctgcaggatgttgcccttgttcgaggcagagacaggaggcctcagacagctgtgacagccctggagctctcctaccacatctgagccagagggaagactttggagaagcagaagcccaaagacactgctgggagattggtctgtgctctgggagaaccctaggttgtgtttcccgtgtacaagtcacggatcttctggaaggtaccaccgctcccagccccgcttggctgagggctgagggccacaggttttcgggactgtgcctgtggttggaggctgtggactcaagctcagttttaccgtcctatctgcagtcggctactttcggtggcagaagaggccacatctgcttcctgtaagccctctgggcagaagcatgcggtggtgtctcttcctgatctgggcccaggggctgaggcaggctcccctcgcctcaggaatgatgacaggcacaatagaaacaacggggaacatttctgcaaagaaaggtggctctgttatcttacaatgtcacctctcctccaccatggcacaagtgacccaggtcaactgggagcagcatgaccattcgcttctggccattcgtaatgctgagttggggtggcacatctacccagccttcaaggatcgagtggccccgggtcctggcctgggcctcaccctccagtcgctgaccatgaatgatacaggggagtacttctgcacctatcacacctaccctgatgggacttacagagggagaatcttcctggaggtcctagaaagctcagtggctgagcacagtgccaggttccagattccattgcttggagccatggccatgatgctggtggtcatctgcatagcagtcatcgtggtggtcgtgttggctagaaagaagaaatccctcagaatccattctgtggaaagtggcctccagagaaaatcaactggacaggaagaacagattcccagtgctccctcacccccaggaagctgtgtccaggcagaagctgcacctgctgggctctgtggagagcagcagggagatgactgtgccgagctgcatgactacttcaatgtcctgagttacagaagcctggggagctgcagcttcttcacagagactgggtagcaaacagagaactcactgaactagattctcctctgaggaccagagaagaccatctcatagctggattcctggagacatgcactgtccacgcgtagccactttccacgtgtggccatcaaccacttaagatggggttagtttaaatcaagatgtg

SEQ ID NO: 553 - DNA, 420 bp, Cynomologus
atgggctggtcctgcatcatcctgtttctggtggccacagccaccggcgtgcacagcatgatgaccggcaccatcgagacaaccggcaacatcagcgccaagaaaggcggcagcgtgatcctgcagtgccacctgtctagcaccatggcccaagtgacccaagtgaactgggagcagcacgaccacagcctgctggccatcagaaatgccgagctgggctggcacatctaccccgccttcaaggacagagtggcccctggacctggcctgggactgacactgcagagcctgaccatgaacgataccggcgagtacttctgcacctaccacacctaccccgacggcacctaccggggcagaatcttcctggaagtgctggaaagcagcgtggccgagcacagcgccagattccagatcccc

SEQ ID NO: 554 - protein, 158 aa, Cynomologus
MGWSCIILFLVATATGVHSMMTGTIETTGNISAKKGGSVILQCHLSSTMAQVTQVNWEQHDHSLLAIRNAELGWHIYPAFKDRVAPGPGLGLTLQSLTMNDTGEYFCTYHTYPDGTYRGRIFLEVLESSVAEHSARFQIPIEGRDYKDDDDKHHHHHH

SEQ ID NO: 555 - protein, 376 aa, Cynomologus
MGWSCIILFLVATATGVHSMMTGTIETTGNISAKKGGSVILQCHLSSTMAQVTQVNWEQHDHSLLAIRNAELGWHIYPAFKDRVAPGPGLGLTLQSLTMNDTGEYFCTYHTYPDGTYRGRIFLEVLESSVAEHSARFQIPIEGREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 556 - protein, 241 aa, Mus Musculus
MHGWLLLVWVQGLIQAAFLATGATAGTIDTKRNISAEEGGSVILQCHFSSDTAEVTQVDWKQQDQLLAIYSVDLGWHVASVFSDRVVPGPSLGLTFQSLTMNDTGEYFCTYHTYPGGIYKGRIFLKVQESSVAQFQTAPLGGTMAAVLGLICLMVTGVTVLARKKSIRMHSIESGLGRTEAEPQEWNLRSLSSPGSPVQTQTAPAGPCGEQAEDDYADPQEYFNVLSYRSLESFIAVSKTG

SEQ ID NO: 557 - DNA, 1006 bp, Mus Musculus
gccagtttcagttggaggagaggccacatccactttgctgtaggcctctggttagaagcatgcatggctggctgctcctggtctgggtccaggggctgatacaggctgccttcctcgctacaggagccacagcaggcacgatagatacaaagaggaacatctctgcagaggaaggtggctctgtcatcttacagtgtcacttctcctctgacacagctgaagtgacccaagtcgactggaagcagcaggaccagcttctggccatttatagtgttgacctggggtggcatgtcgcttcagtcttcagtgatcgggtggtcccaggccccagcctaggcctcaccttccagtctctgacaatgaatgacacgggagagtacttctgtacctatcatacgtatcctggtgggatttacaaggggagaatattcctgaaggtccaagaaagctcagtggctcagttccagactgccccgcttggaggaaccatggctgctgtgctgggactcatttgcttaatggtcacaggagtgactgtactggctagaaagaagtctattagaatgcattctatagaaagtggccttgggagaacagaagcggagccacaggaatggaacctgaggagtctctcatcccctggaagccctgtccagacacaaactgcccctgctggtccctgtggagagcaggcagaagatgactatgctgacccacaggaatactttaatgtcctgagctacagaagcctagagagcttcattgctgtatcgaagactggctaacgacagctctctatccctctccctatgtctctctctctgtctctctctgtctctctctgtctctgtctctgtctctgtctctctctctctctctctctctctctctgtgtgtgtgtgtgtgtatgtgtgtatacatcattaatgttcattaacactaactgcatatggtggaggaccaggaaataaaagtttgtgttgctaataaaattaagtgctaactt

SEQ ID NO: 558 - DNA, 723 bp, Mus Musculus
atgcacggatggctgctgctcgtgtgggtgcagggactgatccaggccgcttttctggccaccggcgctacagccggcaccatcgacaccaagagaaacatcagcgccgaagagggcggcagcgtgatcctgcagtgtcacttcagcagcgacaccgccgaagtgacccaggtggactggaagcagcaggaccagctgctggccatctacagcgtggacctgggctggcatgtggccagcgtgttcagcgacagagtggtgcctggccctagcctgggcctgacattccagagcctgaccatgaacgataccggcgagtacttctgcacctaccacacctaccctggcggcatctacaagggcagaatcttcctgaaggtgcaggaatccagcgtggcccagttccagacagctcctctgggcggcacaatggccgctgtgctggggctgatctgcctgatggtcaccggcgtgacagtgctggcccggaagaaatccatcagaatgcacagcatcgagtccggcctgggcagaacagaggccgagcctcaggaatggaacctgagaagcctgagcagccccggcagccctgtgcagacacagacagcaccagctggcccttgtggcgagcaggccgaggatgattacgccgacccccaggaatacttcaacgtgctgagctacagaagcctggaatcctttatcgccgtgtccaagaccggc

SEQ ID NO: 559 - protein, 249 aa, Mus Musculus
MHGWLLLVWVQGLIQAAFLATAIGATAGTIDTKRNISAEEGGSVILQCHFSSDTAEVTQVDWKQQDQLLAIYSVDLGWHVASVFSDRVVPGPSLGLTFQSLTMNDTGEYFCTYHTYPGGIYKGRIFLKVQESSDDRNGLAQFQTAPLGGTMAAVLGLICLMVTGVTVLARKDKSIRMHSIESGLGRTEAEPQEWNLRSLSSPGSPVQTQTAPAGPCGEQAEDDYADPQEYFNVLSYRSLESFIAVSKTG

SEQ ID NO: 560 - protein, 141 aa, Mus Musculus
MHGWLLLVWVQGLIQAAFLATGATAGTIDTKRNISAEEGGSVILQCHFSSDTAEVTQVDWKQQDQLLAIYSVDLGWHVASVFSDRVVPGPSLGLTFQSLTMNDTGEYFCTYHTYPGGIYKGRIFLKVQESSVAQFQTAPLG

SEQ ID NO: 561 - protein, 141 aa, Mus Musculus; identical to SEQ ID NO: 560

SEQ ID NO: 562 - protein, 358 aa, Mus Musculus
GTIDTKRNISAEEGGSVILQCHFSSDTAEVTQVDWKQQDQLLAIYSVDLGWHVASVFSDRVVPGPSLGLTFQSLTMNDTGEYFCTYHTYPGGIYKGRIFLKVQESSVAQFQTAPLGGTIEGRMDPEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 563 - protein, 417 aa, Homo Sapien
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGMSRNAIIFLVLGILVFLILLGIGIYFYWSKCSREVLWHCHLCPSSTEHASASANGHVSYSAVSRENSSSQDPQTEGTR

SEQ ID NO: 564 - DNA, 5903 bp, Homo Sapien
agcgggactgagcgccgggagagacctgcgcaggcgcaggcgcgcggggagggccagcctgggtggcccaccccgcgcctggcgggactggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagcgggcgccgggaagcgaggagacgcccgcgggaggcccagctgctcggagcaactggcatggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaagagggacctcccagtgagcactcaggcatgtcccgtaacgccatcatcttcctggttctgggaatcctggtttttctgatcctgctggggatcgggatttatttctattggtccaaatgttcccgtgaggtcctttggcactgtcatctgtgtccctcgagtacagagcatgccagcgcctcagctaatgggcatgtctcctattcagctgtgagcagagagaacagctcttcccaggatccacagacagagggcacaaggtgacagcgtcgggactgagaggggagagagactggagctggcaaggacgtgggcctccagagttggacccgaccccaatggatgaagaccccctccaaagagaccagcctccctccctgtgccagacctcaaaacgacgggggcaggtgcaagttcataggtctccaagaccaccctcctttcatttgctagaaggactcactagactcaggaaagctgttaggctcacagttacagtttattacagtaaaaggacagagattaagatcagcaaagggaggaggtgcacagcacacgttccacgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttggctccaagtgatacttctgccttggcctcccaaagtgctgaattaagcagctcaccatccacacggctgacctcatacatcaagccaataccgtgtggcccaagacccccaccataaatcacatcattagcatgaaccacccagagtggcccaagactccaagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctccagcggctgtgtgcaatggggtcttttgtggaaatcaaggagcagacaggtttcatgtgtactgtcaccacgtgggatggaaccagaggcatggaagcaagacgctaaatgaagagggccataagggctgggattcccaggcaccttaggaacagcttgtctttttttttttcctctccaaaaaaaatgtttaagggacggtgtctcctgtcacccaggctggagtgcaatggcacgatcatagctcattgcagcctctaactccggggctcaagcaatcctcccacctcagcctaccaagtagctgtgaccacagctgcccctcaccatgctaagctaatttttttaattagatagtacataaacgtcccaaaattagaagataaaaagacatgagggatccattctaatttgtgtttggagtgtaatggtccagctccattcttctgcacatggatatccagttttacacaacactgtgaatgtaatgaatgccactgaatcatacactcaaaaatagctaaaatggcaaattgtctgttatctctttttaaccaccatttttgaaaattaattataccaaaaaaccattgaatagtgcactttatttatttatttatttgtttatttatttatttattttagaaataagagtctcactttgttgcccaggctggagtgcagtggcgtgatcatggctcattgcagcctcgacctgctgggctcgggctatccttccatctcagcctcccgagtagctgggactataggtgggcgccaccccacctggctaaatctctttttaacttttgtagagataggcatctcgctatgttgcctaggctgggctggaactcctgggctcaagtgctcctcctgccttggcctcccaaagcgctaggattacagatgtgagccaccgcgcccaccctgaaccttactttttttgctcagtttctggtaattcagagaatgcctcctgagttgttctacacccacctcatattccatgggagggctgtacagggcttttttaacgaggcctctaaggacaggcatttgtatcctttccagcctttcactattacaatgttgtagtgaataactttacacactgtcatttattttacttttttttttttttattttagagaaaggaatcttgccatcttgcccaggctggtctcaaattcctgggcccaaacaatcctcccgccttggcctcctaaagtactgggatttataggcataagccaccgtgcctggccaatgcacactgtcatttagctcatgttaacacctgagtgtaggacacactcctggaggtggaattgctgggccaaagagtatgtttcttgtcattgtgatagatattgacaaatgaaccctcacagaagttgtgctgagttctgttcccaccagcgacgtaggcgatgacctttttctggagggagggggcatccttggagtccacagagccaggaatggagagtgggcccagaattttggtataggtgttgtataaacttatagtaaggttaagaaaaccgcaactatccttatcagagacttggcggggggcagggtatgatggagatcataaggaggctaaaacactccacaccctccctctgcattgctcctgcacgggagtcgggaatcttttcaggttgatacgatctcaccttgaggagctgtgaggtcccagaagcctctgggttgcagattgcttggggtgaaaatgtctgtgctactgaaatctaactttttacaaaaaattacgggctgggcgcagtggctcacgcctgtaatcccagcactttgggaggctgcagcgggtggatcacttgaggtaaggagttcaagaccagaccatagtgaaaccgtgtctctacaaaaaaaattagccaggtgtggtggtgcatgcttgtaatcccagctactcagaaggctgaggtgggagaatcccttgaacccgggaagtggaggctggagtaaaccatgatcgagttactgcactccagcctgggtgacaagagtgagactctgtctccaaaaaaaaaaaaaaaaaaaaaaaaactggattgcctggctctactccgggcacagcatgcaggcccagttctgctgctctgctgtttgttctgctttcctccacatattggcatcaccctctggtgccaagatggctgctgcattccaggcatcacatccagactcagacccagagaagctgcccatccctacctgggtgagcctttgtaggaacgagaaaccgcatccagcagcagaaacctcacccagcagcgtcttttccggtctcattcaccagcgccgcccaccgctcaaccaatccctggccaaaagaatgggaccgcctggaaggctggaccaaacaggacctgccctctggggctggggagaggcccagatgaaggctgcaggacaggatggactcctagacctctgttaccagcagtgactacctctgtctgggtggttggaacatgtttgaattttattctaagtactgtctacaagttctgcaataaaccttgactcttcttttaataatgcaaa

SEQ ID NO: 565 - protein, 417 aa, Homo Sapien
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRNAIIFLVLGILVFLILLGIGIYFYWSKCSREVLWHCHLCPSSTEHASASANGHVSYSAVSRENSSSQDPQTEGTR

SEQ ID NO: 566 - protein, 372 aa, Homo Sapien
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGTEHASASANGHVSYSAVSRENSSSQDPQTEGTR

SEQ ID NO: 567 - DNA, 5768 bp, Homo Sapien
agcgggactgagcgccgggagagacctgcgcaggcgcaggcgcgcggggagggccagcctgggtggcccaccccgcgcctggcgggactggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagcgggcgccgggaagcgaggagacgcccgcgggaggcccagctgctcggagcaactggcatggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaagagggacctcccagtgagcactcaggtacagagcatgccagcgcctcagctaatgggcatgtctcctattcagctgtgagcagagagaacagctcttcccaggatccacagacagagggcacaaggtgacagcgtcgggactgagaggggagagagactggagctggcaaggacgtgggcctccagagttggacccgaccccaatggatgaagaccccctccaaagagaccagcctccctccctgtgccagacctcaaaacgacgggggcaggtgcaagttcataggtctccaagaccaccctcctttcatttgctagaaggactcactagactcaggaaagctgttaggctcacagttacagtttattacagtaaaaggacagagattaagatcagcaaagggaggaggtgcacagcacacgttccacgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttggctccaagtgatacttctgccttggcctcccaaagtgctgaattaagcagctcaccatccacacggctgacctcatacatcaagccaataccgtgtggcccaagacccccaccataaatcacatcattagcatgaaccacccagagtggcccaagactccaagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctccagcggctgtgtgcaatggggtcttttgtggaaatcaaggagcagacaggtttcatgtgtactgtcaccacgtgggatggaaccagaggcatggaagcaagacgctaaatgaagagggccataagggctgggattcccaggcaccttaggaacagcttgtctttttttttttcctctccaaaaaaaatgtttaagggacggtgtctcctgtcacccaggctggagtgcaatggcacgatcatagctcattgcagcctctaactccggggctcaagcaatcctcccacctcagcctaccaagtagctgtgaccacagctgcccctcaccatgctaagctaatttttttaattagatagtacataaacgtcccaaaattagaagataaaaagacatgagggatccattctaatttgtgtttggagtgtaatggtccagctccattcttctgcacatggatatccagttttacacaacactgtgaatgtaatgaatgccactgaatcatacactcaaaaatagctaaaatggcaaattgtctgttatctctttttaaccaccatttttgaaaattaattataccaaaaaaccattgaatagtgcactttatttatttatttatttgtttatttatttatttattttagaaataagagtctcactttgttgcccaggctggagtgcagtggcgtgatcatggctcattgcagcctcgacctgctgggctcgggctatccttccatctcagcctcccgagtagctgggactataggtgggcgccaccccacctggctaaatctctttttaacttttgtagagataggcatctcgctatgttgcctaggctgggctggaactcctgggctcaagtgctcctcctgccttggcctcccaaagcgctaggattacagatgtgagccaccgcgcccaccctgaaccttactttttttgctcagtttctggtaattcagagaatgcctcctgagttgttctacacccacctcatattccatgggagggctgtacagggcttttttaacgaggcctctaaggacaggcatttgtatcctttccagcctttcactattacaatgttgtagtgaataactttacacactgtcatttattttacttttttttttttttattttagagaaaggaatcttgccatcttgcccaggctggtctcaaattcctgggcccaaacaatcctcccgccttggcctcctaaagtactgggatttataggcataagccaccgtgcctggccaatgcacactgtcatttagctcatgttaacacctgagtgtaggacacactcctggaggtggaattgctgggccaaagagtatgtttcttgtcattgtgatagatattgacaaatgaaccctcacagaagttgtgctgagttctgttcccaccagcgacgtaggcgatgacctttttctggagggagggggcatccttggagtccacagagccaggaatggagagtgggcccagaattttggtataggtgttgtataaacttatagtaaggttaagaaaaccgcaactatccttatcagagacttggcggggggcagggtatgatggagatcataaggaggctaaaacactccacaccctccctctgcattgctcctgcacgggagtcgggaatcttttcaggttgatacgatctcaccttgaggagctgtgaggtcccagaagcctctgggttgcagattgcttggggtgaaaatgtctgtgctactgaaatctaactttttacaaaaaattacgggctgggcgcagtggctcacgcctgtaatcccagcactttgggaggctgcagcgggtggatcacttgaggtaaggagttcaagaccagaccatagtgaaaccgtgtctctacaaaaaaaattagccaggtgtggtggtgcatgcttgtaatcccagctactcagaaggctgaggtgggagaatcccttgaacccgggaagtggaggctggagtaaaccatgatcgagttactgcactccagcctgggtgacaagagtgagactctgtctccaaaaaaaaaaaaaaaaaaaaaaaaactggattgcctggctctactccgggcacagcatgcaggcccagttctgctgctctgctgtttgttctgctttcctccacatattggcatcaccctctggtgccaagatggctgctgcattccaggcatcacatccagactcagacccagagaagctgcccatccctacctgggtgagcctttgtaggaacgagaaaccgcatccagcagcagaaacctcacccagcagcgtcttttccggtctcattcaccagcgccgcccaccgctcaaccaatccctggccaaaagaatgggaccgcctggaaggctggaccaaacaggacctgccctctggggctggggagaggcccagatgaaggctgcaggacaggatggactcctagacctctgttaccagcagtgactacctctgtctgggtggttggaacatgtttgaattttattctaagtactgtctacaagttctgcaataaaccttgactcttcttttaataatgcaaa

SEQ ID NO: 568 - protein, 364 aa, Homo Sapien
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKGTEHASASANGHVSYSAVSRENSSSQDPQTEGTR

SEQ ID NO: 569 - DNA, 5744 bp, Homo Sapien
agcgggactgagcgccgggagagacctgcgcaggcgcaggcgcgcggggagggccagcctgggtggcccaccccgcgcctggcgggactggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagcgggcgccgggaagcgaggagacgcccgcgggaggcccagctgctcggagcaactggcatggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaaggtacagagcatgccagcgcctcagctaatgggcatgtctcctattcagctgtgagcagagagaacagctcttcccaggatccacagacagagggcacaaggtgacagcgtcgggactgagaggggagagagactggagctggcaaggacgtgggcctccagagttggacccgaccccaatggatgaagaccccctccaaagagaccagcctccctccctgtgccagacctcaaaacgacgggggcaggtgcaagttcataggtctccaagaccaccctcctttcatttgctagaaggactcactagactcaggaaagctgttaggctcacagttacagtttattacagtaaaaggacagagattaagatcagcaaagggaggaggtgcacagcacacgttccacgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttggctccaagtgatacttctgccttggcctcccaaagtgctgaattaagcagctcaccatccacacggctgacctcatacatcaagccaataccgtgtggcccaagacccccaccataaatcacatcattagcatgaaccacccagagtggcccaagactccaagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctccagcggctgtgtgcaatggggtcttttgtggaaatcaaggagcagacaggtttcatgtgtactgtcaccacgtgggatggaaccagaggcatggaagcaagacgctaaatgaagagggccataagggctgggattcccaggcaccttaggaacagcttgtctttttttttttcctctccaaaaaaaatgtttaagggacggtgtctcctgtcacccaggctggagtgcaatggcacgatcatagctcattgcagcctctaactccggggctcaagcaatcctcccacctcagcctaccaagtagctgtgaccacagctgcccctcaccatgctaagctaatttttttaattagatagtacataaacgtcccaaaattagaagataaaaagacatgagggatccattctaatttgtgtttggagtgtaatggtccagctccattcttctgcacatggatatccagttttacacaacactgtgaatgtaatgaatgccactgaatcatacactcaaaaatagctaaaatggcaaattgtctgttatctctttttaaccaccatttttgaaaattaattataccaaaaaaccattgaatagtgcactttatttatttatttatttgtttatttatttatttattttagaaataagagtctcactttgttgcccaggctggagtgcagtggcgtgatcatggctcattgcagcctcgacctgctgggctcgggctatccttccatctcagcctcccgagtagctgggactataggtgggcgccaccccacctggctaaatctctttttaacttttgtagagataggcatctcgctatgttgcctaggctgggctggaactcctgggctcaagtgctcctcctgccttggcctcccaaagcgctaggattacagatgtgagccaccgcgcccaccctgaaccttactttttttgctcagtttctggtaattcagagaatgcctcctgagttgttctacacccacctcatattccatgggagggctgtacagggcttttttaacgaggcctctaaggacaggcatttgtatcctttccagcctttcactattacaatgttgtagtgaataactttacacactgtcatttattttacttttttttttttttattttagagaaaggaatcttgccatcttgcccaggctggtctcaaattcctgggcccaaacaatcctcccgccttggcctcctaaagtactgggatttataggcataagccaccgtgcctggccaatgcacactgtcatttagctcatgttaacacctgagtgtaggacacactcctggaggtggaattgctgggccaaagagtatgtttcttgtcattgtgatagatattgacaaatgaaccctcacagaagttgtgctgagttctgttcccaccagcgacgtaggcgatgacctttttctggagggagggggcatccttggagtccacagagccaggaatggagagtgggcccagaattttggtataggtgttgtataaacttatagtaaggttaagaaaaccgcaactatccttatcagagacttggcggggggcagggtatgatggagatcataaggaggctaaaacactccacaccctccctctgcattgctcctgcacgggagtcgggaatcttttcaggttgatacgatctcaccttgaggagctgtgaggtcccagaagcctctgggttgcagattgcttggggtgaaaatgtctgtgctactgaaatctaactttttacaaaaaattacgggctgggcgcagtggctcacgcctgtaatcccagcactttgggaggctgcagcgggtggatcacttgaggtaaggagttcaagaccagaccatagtgaaaccgtgtctctacaaaaaaaattagccaggtgtggtggtgcatgcttgtaatcccagctactcagaaggctgaggtgggagaatcccttgaacccgggaagtggaggctggagtaaaccatgatcgagttactgcactccagcctgggtgacaagagtgagactctgtctccaaaaaaaaaaaaaaaaaaaaaaaaactggattgcctggctctactccgggcacagcatgcaggcccagttctgctgctctgctgtttgttctgctttcctccacatattggcatcaccctctggtgccaagatggctgctgcattccaggcatcacatccagactcagacccagagaagctgcccatccctacctgggtgagcctttgtaggaacgagaaaccgcatccagcagcagaaacctcacccagcagcgtcttttccggtctcattcaccagcgccgcccaccgctcaaccaatccctggccaaaagaatgggaccgcctggaaggctggaccaaacaggacctgccctctggggctggggagaggcccagatgaaggctgcaggacaggatggactcctagacctctgttaccagcagtgactacctctgtctgggtggttggaacatgtttgaattttattctaagtactgtctacaagttctgcaataaaccttgactcttcttttaataatgcaaa

SEQ ID NO: 570 - protein, 392 aa, Homo Sapien
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRNAIIFLVLGILVFLILLGIGIYFYWSKCSREVLWHCHLCPSSEHHQSCRN

SEQ ID NO: 571 - DNA, 1643 bp, Homo Sapien
agcgggactgagcgccgggagagacctgcgcaggcgcaggcgcgcggggagggccagcctgggtggcccaccccgcgcctggcgggactggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagcgggcgccgggaagcgaggagacgcccgcgggaggcccagctgctcggagcaactggcatggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaagagggacctcccagtgagcactcaggcatgtcccgtaacgccatcatcttcctggttctgggaatcctggtttttctgatcctgctggggatcgggatttatttctattggtccaaatgttcccgtgaggtcctttggcactgtcatctgtgtccctcgagtgagcatcaccagagctgccgtaattgagcacctactacgggctctgtgctgagtccttccagtgtgcctctcactgaatcctcaccccactgccatgaggtttcccccatttgactgatgagggtgcagagccagggagccttgttcactggttcattgattacatttacaaatattatttacagagtggga

SEQ ID NO: 572 - DNA, 1008 bp, Homo Sapien
atggggtggtcttgtatcatactgtttcttgtggcaaccgcaactggtgtgcattctggagacgtagtggtccaggctcctacacaggtccccggcttccttggtgatagcgtcactctcccttgttacctgcaggtgccaaatatggaggtcactcacgtgagccaactcacctgggcacggcatggggaaagtggatctatggcagttttccaccaaactcaggggccatcttactccgagtccaaacggttggagtttgtcgctgcaagactgggcgccgagctccgtaacgcatcactccgtatgtttgggctgagagttgaagatgaaggaaactatacatgcctgttcgtgacatttccccaggggtctcggtccgtcgacatctggttgcgagtgcttgccaaaccacagaacacagcagaagtgcagaaagtgcagctcactggggaacccgtgccaatggccaggtgtgtttccaccggtggccgtcctccagcacagatcacctggcactcagatctgggcggcatgcctaacacaagtcaggtgcctggctttcttagcggcactgtgactgtgacatctctgtggatcctggtgccttctagtcaagtagacggaaagaacgtaacttgtaaagtggaacatgagagcttcgaaaagccccagttgcttacagttaacctcactgtgtactatcccccagaggtctcaatctccggctatgataacaactggtaccttgggcaaaacgaagccacactgacttgcgacgcacggtccaacccagagcccacaggatataactggagtactaccatgggcccacttcctcccttcgcagtggcccaaggcgctcagctgctgatccgtccagtggataagcctattaacactacactgatttgcaatgttacaaacgccctcggagctcgacaagcagaattgaccgtgcaggttaaagagggacccccttccgaacacagcggcatgtccaggaac

SEQ ID NO: 573 - protein, 354 aa, Homo Sapien
MGWSCIILFLVATATGVHSGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGMSRNIEGRDYKDDDDKHHHHHH

SEQ ID NO: 574 - protein, 572 aa, Homo Sapien
MGWSCIILFLVATATGVHSGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGMSRNIEGREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 575 - protein, 317 aa, Homo Sapien
GDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGMSRN

SEQ ID NO: 576 - protein, 538 aa, Homo Sapien
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 577 - DNA, 2869 bp, Homo Sapien
agaattctttggcaggggcgaccttagaatcctggggaggagcgagaatggaatcccggggaggaacaggggtggaatccggggggcggggtcagaacgccaggagggggcggggccggagccagggtcggcttgactcgggggagcagcgggtggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagagacccccaacacagcaggcgcaggggccacaggcggcatcatcgggggcatcatcgccgccatcattgctactgctgtggctgccacgggcatccttatctgccggcagcagcggaaggagcagacgctgcagggggcagaggaggacgaagacctggagggacctccctcctacaagccaccgaccccaaaagcgaagctggaggcacaggagatgccctcccagctcttcactctgggggcctcggagcacagcccactcaagaccccctactttgatgctggcgcctcatgcactgagcaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtgagctgccatgcgcctggcgtctcacatctcacctgttgatcccttagctttcttgccaaggatctagtgccccctgacctctggccaggccactgtcagttaacacatatgcattccatttgtgatgtctaccttggtggctccactatgacccctaacccatgagcccagagaaattcaccgtgataatggaatcctggcaaccttatctcatgaggcaggaggtggggaaggtgcttctgcacaacctctgatcccaaggactcctctcccagactgtgaccttagaccatacctctcaccccccaatgcctcgactcccccaaaatcacaaagaagaccctagacctataatttgtcttcaggtagtaaattcccaataggtctgctggagtgggcgctgagggctccctgctgctcagacctgagccctccaggcagcagggtcccacttaccccctccccaccctgttccccaaaggtgggaaagaggggattccccagcccaaggcagggttttcccagcaccctcctgtaagcagaagtctcagggtccagacccttccctgagcccccacccccaccccaattcctgcctaccaagcaagcagccccagcctagggtcagacagggtgagcctcatacagactgtgccttgatggccccagccttgggagaagaatttactgttaacctggaagactactgaatcattttacccttgcccagtggaataggacctaaacatcccccttccggggaaagtgggtcatctgaattgggggtagcaattgatactgttttgtaaactacatttcctacaaaatatgaatttatactttgaccaggaaaaaaaaaaaaa

SEQ ID NO: 578 - protein, 479 aa, Homo Sapien
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPRASPRDVGPLVWGAVGGTLLVLLLLAGGSLAFILLRVRRRRKSPGGAGGGASGDGGFYDPKAQVLGNGDPVFWTPVVPGPMEPDGKDEEEEEEEEKAEKGLMLPPPPALEDDMESQLDGSLISRRAVYV

SEQ ID NO: 579 - DNA, 2166 bp, Homo Sapien
agaattctttggcaggggcgaccttagaatcctggggaggagcgagaatggaatcccggggaggaacaggggtggaatccggggggcggggtcagaacgccaggagggggcggggccggagccagggtcggcttgactcgggggagcagcgggtggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagaaacccccagggcctcgccccgagatgtgggcccgctggtgtggggggccgtgggggggacactgctggtgctgctgcttctggctggggggtccttggccttcatcctgctgagggtgaggaggaggaggaagagccctggaggagcaggaggaggagccagtggcgacgggggattctacgatccgaaagctcaggtgttgggaaatggggaccccgtcttctggacaccagtagtccctggtcccatggaaccagatggcaaggatgaggaggaggaggaggaggaagagaaggcagagaaaggcctcatgttgcctccacccccagcactcgaggatgacatggagtcccagctggacggctccctcatctcacggcgggcagtttatgtgtgacctggacacagacagagacagagccaggcccggccctcccgcccccgacctgaccacgccggcctagggttccagactggttggacttgttcgtctggacgacactggagtggaacactgcctcccactttcttgggacttggagggaggtggaacagcacactggacttctcccgtctctagggctgcatggggagcccggggagctgagtagtggggatccagagaggacccccgcccccagagacttggttttggctccagccttcccctggccccgtgacactcaggagttaataaatgccttggaggaaaacatcaaaaaaaaaaaaaaaa

SEQ ID NO: 580 - protein, 549 aa, Homo Sapien
MARTLRPSPLCPGGGKAQLSSASLLGAGLLLQPPTPPPLLLLLFPLLLFSRLCGALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLIDGGNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISDPPTTTTLQPTIQWHPSTADIEDLATEPKKLPFPLSTLATIKDDTIATIIASVVGGALFIVLVSVLAGIFCYRRRRTFRGDYFAKNYIPPSDMQKESQIDVLQQDELDSYPDSVKKENKNPVNNLIRKDYLEEPEKTQWNNVENLNRFERPMDYYEDLKMGMKFVSDEHYDENEDDLVSHVDGSVISRREWYV

SEQ ID NO: 581 - DNA, 5265 bp, Homo Sapien
acgcgggcgggtgccgaggggaggggagtggcggcggcggcgggcggctcccgcttcagcctcggcagtggcgtcggcgacggcggtgtcgaggcagccgccagcgttcggccaagtgtcagccggcagcgacggcgctagagctgggagctggggacgcgcgcgccggaccttccacagcctccgcccagagcctgaggcgccggggccgggggagccggggggcgggcgggcgagcgggccggggggagggtgggggatggcgcggaccctgcggccgtccccgctgtgtcctggaggcggcaaagcacaactttcctccgcttctctcctcggagccgggctcctgctgcagcccccgacgccacctccgctgctgctgctgctcttcccgctgctgctcttctccaggctctgtggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagatcctcctactactaccacccttcagcctacaattcagtggcatccctcaactgctgacatcgaggatctagcaacagaacctaaaaaattgcccttcccattgtcaactttggcaacaattaaggatgacacaattgccacgatcattgctagtgtagtgggtggggctctcttcatagtacttgtaagtgttttggctggaatattctgctataggagaagacggacgtttcgtggagactactttgccaagaactacattccaccatcagatatgcaaaaagaatcacaaatagatgttcttcaacaagatgagcttgattcttacccagacagtgtaaaaaaagaaaacaaaaatccagtgaacaatctaatacgtaaagactatttagaagagcctgaaaaaactcagtggaacaatgtagaaaatctcaataggtttgaaagaccaatggattattatgaagatctaaaaatgggaatgaagtttgtcagtgatgaacattatgatgaaaacgaagatgacttagtttcacatgtagatggttccgtaatttccaggagggagtggtatgtttagcaaccactgaatgtgacttaactatgtacaatgttcattcacactagttgatcattttcagattgttcatactttttcttgaggaagaataagctttttcaagttgattttcaagcttactttttatattctaatctgacaaatgaaaatgtaaaatctgagttcagtgtatctaagctgctttacaattttttttcaatgctgtactactgtctcaagatttaaattttaatgcagagtactttattggtgtgaggcacacaggtaagaagaaatgtcaacattaaatgtatgacttacttggtacaaaaattttttaaaaagggaactaccttgacattgtgtattaaatgtttacctaagactataatctcaagtatgatgtttgtttaacatatacctctcaaaatttatcaccactcaatgacactgcatcaaaattgactataaaactaattcaagaaatatttatatatattttttaatatacaaaaaatatttagcctgatggaatggctttccttttcaaacattattttctaagtttctatacaaatgaaatctttacctctgcatattaatgagccttgccataattactgtagagtggcttttcaaagatattttgttgcactaaaactgtggtagtaaactcagtgaacatgatgtgtggaagagcataattagctggtcaatatttttgtccaaaatacctgcaagagtaataaaatacatacctttcaaacatgataattattagtttttttttttcctttctggaacatggattttggtacattagcagtagccttattttaatgctttatgtcctaaacatactaatagaaatgaaaagacgcagagagagcatttcggaatactgaagtactagttttagaaatgagactttcagccaacaatctatagaaagaattttatggaccatcttgttttagttatttaatgttgatgttgttcaaatgggtaaatgtacagaaagaaaattttagagtaaacttggaactttggatataactagaaaaaactagattatagaattagtcggtaacacttgctaatggacattggcattcatctcctttttcctcctaagtgtatgtatgtgttttaagatttctgtttttacgattaaaactggaaacatgaggttttttgtttttgtttttttacataattacatatattccttctgaatcatttatcttttgagaaagaaatgttacctaaacttcaaatgtgctttttgtttgtgaggtaattaaattgcttctacagtggaggcttacaaaattattgtgacaactattttgaagctgaaaggatagtttttctattgctaagtcatttgaaaaagtgaccattttgccagtgaaatgaagtggaagttagtaggagaatcataaattaaatatattattttgttaataaaaaggcaaagtagtaggtactttttaaaccctcccaaccagccctttctcaatattcatcaaatctaaaacatttagggggcaaaattctaacatgttcatggtatcttgcaaatagtgaaagctttattctgaaggattataaactagttttcttcattttaactagcactattttgtggaaattagaaacctcttttatttctcttcccaaaagtaatacttattataaggctgtagtatcaggttaaggatacagataaataaagttcacttatatcttcttacaaatgtctgggttttaatatggttaatcacttatatacaaatattacaactttttagtgcaagtttttggaagaaaactttttgataaaacactgtgattgatgtgactttatttttaatttaaacgatgaggtggccagaagaaagatgggtctaaaatttctccccatgaaagatgtaaaactatggctttttttaaaatcaaaatttcatcttttaaaataatggtttgaaatactgtatggatctgaacagaataatcacatttaggattctatataaatctcaactggagtataatctgaaggaaattagcagtgtattttaagaaatatatttcaaaaatataaatactgattatgaacttccttttacattgtggttatttgtgcgattaggtttttttgtttgtttcttttgtgtttgtttggcgggagagggtgacctggaaagccacaagtgagtatttgacatattctgtatccttaatccaatcatttggcaaactaaaaggtttctgtgttgtaagaatctgatactagtgcttaagactttgggaagcattgcactgttgtttattagaactttatgtatatttactgtacatagagacttgtttgaaaacatgaatagtcattaaataaagacattgttaaattagtttttgaataccagtgatattcataactacttgacaggtatatatgaaaattctactatcgtgaaaaaaaatgaatatttgtactatttttggccatatttatatttatttctttcatatggtttgaactgttttagcattttgtaaattcacttgagagttttctttcatactggttaaaatatttcaatgatataatgaagatgaatgcaactcttatttttctgccattttttattaaaatacattgaaactaaagtaggctcggggttaactttaaaagtgatatttgagaagtgctttagagttgaaagatttagtattttaccacgtgcctagtagggttctatttgctaactctaatattgaggaaactattaaggttttcagtagtaagtgttgcttctaatagccatatacaggaaagttttataagataacccacggctaaatattttgcattaaggagctgtaggagtacagtgtataagtacagaaattgagagaaatgtagtcattttatatgtgaaaacatctgatttgagtttttgataaatactgctaaaacacagtatatgaacaagtaagaagtttatgtatgaaagtaatcaatgtaaaatataagaaaggaataaatggtacccattttgaatttttaattctaataggagagtagattgtagattgaattgtctttcctgtttacttgttaattagaaaatgcatccttcataaacagctcctttctcaaattttttgtatattgtgtttgtgtttgggttttagtttgtacccgcgctaagttttggttttgttgtgtttggtgttttttgttttgttttgttttgttttgttttttcttttttaaccaacctgtgtattaggtgttagccccaatagccatgcatgaaatctttaaataaaagttaaaaaagttctttagaggcaaaaaaaaaaaa

SEQ ID NO: 582 - protein, 366 aa, Homo Sapien
MARTLRPSPLCPGGGKAQLSSASLLGAGLLLQPPTPPPLLLLLFPLLLFSRLCGALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLIDGGNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISAYNSVASLNC

SEQ ID NO: 583 - DNA, 5239 bp, Homo Sapien
acgcgggcgggtgccgaggggaggggagtggcggcggcggcgggcggctcccgcttcagcctcggcagtggcgtcggcgacggcggtgtcgaggcagccgccagcgttcggccaagtgtcagccggcagcgacggcgctagagctgggagctggggacgcgcgcgccggaccttccacagcctccgcccagagcctgaggcgccggggccgggggagccggggggcgggcgggcgagcgggccggggggagggtgggggatggcgcggaccctgcggccgtccccgctgtgtcctggaggcggcaaagcacaactttcctccgcttctctcctcggagccgggctcctgctgcagcccccgacgccacctccgctgctgctgctgctcttcccgctgctgctcttctccaggctctgtggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagcctacaattcagtggcatccctcaactgctgacatcgaggatctagcaacagaacctaaaaaattgcccttcccattgtcaactttggcaacaattaaggatgacacaattgccacgatcattgctagtgtagtgggtggggctctcttcatagtacttgtaagtgttttggctggaatattctgctataggagaagacggacgtttcgtggagactactttgccaagaactacattccaccatcagatatgcaaaaagaatcacaaatagatgttcttcaacaagatgagcttgattcttacccagacagtgtaaaaaaagaaaacaaaaatccagtgaacaatctaatacgtaaagactatttagaagagcctgaaaaaactcagtggaacaatgtagaaaatctcaataggtttgaaagaccaatggattattatgaagatctaaaaatgggaatgaagtttgtcagtgatgaacattatgatgaaaacgaagatgacttagtttcacatgtagatggttccgtaatttccaggagggagtggtatgtttagcaaccactgaatgtgacttaactatgtacaatgttcattcacactagttgatcattttcagattgttcatactttttcttgaggaagaataagctttttcaagttgattttcaagcttactttttatattctaatctgacaaatgaaaatgtaaaatctgagttcagtgtatctaagctgctttacaattttttttcaatgctgtactactgtctcaagatttaaattttaatgcagagtactttattggtgtgaggcacacaggtaagaagaaatgtcaacattaaatgtatgacttacttggtacaaaaattttttaaaaagggaactaccttgacattgtgtattaaatgtttacctaagactataatctcaagtatgatgtttgtttaacatatacctctcaaaatttatcaccactcaatgacactgcatcaaaattgactataaaactaattcaagaaatatttatatatattttttaatatacaaaaaatatttagcctgatggaatggctttccttttcaaacattattttctaagtttctatacaaatgaaatctttacctctgcatattaatgagccttgccataattactgtagagtggcttttcaaagatattttgttgcactaaaactgtggtagtaaactcagtgaacatgatgtgtggaagagcataattagctggtcaatatttttgtccaaaatacctgcaagagtaataaaatacatacctttcaaacatgataattattagtttttttttttcctttctggaacatggattttggtacattagcagtagccttattttaatgctttatgtcctaaacatactaatagaaatgaaaagacgcagagagagcatttcggaatactgaagtactagttttagaaatgagactttcagccaacaatctatagaaagaattttatggaccatcttgttttagttatttaatgttgatgttgttcaaatgggtaaatgtacagaaagaaaattttagagtaaacttggaactttggatataactagaaaaaactagattatagaattagtcggtaacacttgctaatggacattggcattcatctcctttttcctcctaagtgtatgtatgtgttttaagatttctgtttttacgattaaaactggaaacatgaggttttttgtttttgtttttttacataattacatatattccttctgaatcatttatcttttgagaaagaaatgttacctaaacttcaaatgtgctttttgtttgtgaggtaattaaattgcttctacagtggaggcttacaaaattattgtgacaactattttgaagctgaaaggatagtttttctattgctaagtcatttgaaaaagtgaccattttgccagtgaaatgaagtggaagttagtaggagaatcataaattaaatatattattttgttaataaaaaggcaaagtagtaggtactttttaaaccctcccaaccagccctttctcaatattcatcaaatctaaaacatttagggggcaaaattctaacatgttcatggtatcttgcaaatagtgaaagctttattctgaaggattataaactagttttcttcattttaactagcactattttgtggaaattagaaacctcttttatttctcttcccaaaagtaatacttattataaggctgtagtatcaggttaaggatacagataaataaagttcacttatatcttcttacaaatgtctgggttttaatatggttaatcacttatatacaaatattacaactttttagtgcaagtttttggaagaaaactttttgataaaacactgtgattgatgtgactttatttttaatttaaacgatgaggtggccagaagaaagatgggtctaaaatttctccccatgaaagatgtaaaactatggctttttttaaaatcaaaatttcatcttttaaaataatggtttgaaatactgtatggatctgaacagaataatcacatttaggattctatataaatctcaactggagtataatctgaaggaaattagcagtgtattttaagaaatatatttcaaaaatataaatactgattatgaacttccttttacattgtggttatttgtgcgattaggtttttttgtttgtttcttttgtgtttgtttggcgggagagggtgacctggaaagccacaagtgagtatttgacatattctgtatccttaatccaatcatttggcaaactaaaaggtttctgtgttgtaagaatctgatactagtgcttaagactttgggaagcattgcactgttgtttattagaactttatgtatatttactgtacatagagacttgtttgaaaacatgaatagtcattaaataaagacattgttaaattagtttttgaataccagtgatattcataactacttgacaggtatatatgaaaattctactatcgtgaaaaaaaatgaatatttgtactatttttggccatatttatatttatttctttcatatggtttgaactgttttagcattttgtaaattcacttgagagttttctttcatactggttaaaatatttcaatgatataatgaagatgaatgcaactcttatttttctgccattttttattaaaatacattgaaactaaagtaggctcggggttaactttaaaagtgatatttgagaagtgctttagagttgaaagatttagtattttaccacgtgcctagtagggttctatttgctaactctaatattgaggaaactattaaggttttcagtagtaagtgttgcttctaatagccatatacaggaaagttttataagataacccacggctaaatattttgcattaaggagctgtaggagtacagtgtataagtacagaaattgagagaaatgtagtcattttatatgtgaaaacatctgatttgagtttttgataaatactgctaaaacacagtatatgaacaagtaagaagtttatgtatgaaagtaatcaatgtaaaatataagaaaggaataaatggtacccattttgaatttttaattctaataggagagtagattgtagattgaattgtctttcctgtttacttgttaattagaaaatgcatccttcataaacagctcctttctcaaattttttgtatattgtgtttgtgtttgggttttagtttgtacccgcgctaagttttggttttgttgtgtttggtgttttttgttttgttttgttttgttttgttttttcttttttaaccaacctgtgtattaggtgttagccccaatagccatgcatgaaatctttaaataaaagttaaaaaagttctttagaggcaaaaaaaaaaaa

SEQ ID NO: 584 - protein, 487 aa, Homo Sapien
MAEGWRWCFVRRTPGLLRGPLLPRSFSGNPRALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLIDGGNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISDVPFKQTSSIAVAGAVIGAVLALFIIAIFVTVLLTPRKKRPSYLDKVIDLPPTHKPPPLYEERSPPLPQKDLFQPEHLPLQTQFKEREVGNLQHSNGLNSRSFDYEDENPVGEDGIQQMYPLYNQMCYQDRSPGKHHQNNDPKRVYIDPREHYV

SEQ ID NO: 585 - DNA, 2522 bp, Homo Sapien
aggctctgtggtaggtgaacctcggcggccggcgtgggctgagggagccgccactgagggtgcgggcgccgcggccggctctgccagccgttctctggagcagcgaggcggttggttgtgcgagcgagtgccgaggactttggctggaaacttttcgccgcgcccggggcgaggccctggaagggccaggccagcgaatgctgagccggcggcccgctgccctcccccgcggccgcgcgggtcgccgtgcggatggccgagggttggcgatggtgcttcgtgcgccgaactccgggtttgctccggggaccgttacttcctcgctcattctctgggaaccctcgtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagatgttccatttaagcagacctcttccatagctgtagctggagcggtaattggagctgttcttgcccttttcatcattgctatctttgtgactgtgctgctgactcctcgaaaaaaaagaccatcctatcttgacaaagtgattgaccttccacccacacataaaccacctcctctgtatgaagaacgatccccacctttgcctcagaaagacctatttcagcctgaacacttgcctttgcagactcagttcaaagaaagagaagttggcaatcttcagcactctaatggactaaatagcaggagttttgactatgaagatgagaatccagttggggaagatggcattcagcagatgtaccccctttacaatcaaatgtgctaccaagaccggagccctggcaaacatcatcaaaataacgaccctaagagagtctacatcgacccacgagaacattatgtgtgatttttctctttttccaatgggcgttctaacaaatgtttattcttagattggggagagaagctaaggccaatagttattttactgtctctcatataagaacagtcccactctaagggtattggaagtcttaatgaatgacgtaaagccaatagcaaatttcttttcttcattaagcgtttcttaaccaccagctgtgtttgtgaacttgactatagctttgtgtgtttctgtgatgatggtatttaactgctaacatttggcctacaatggcattttcatttaacagtacagcatctgcctgtgataactgcagtgattctccagaaagaaaggccccagctgatactattaacctcgttgggtctcaggcatgctagcctgttcatctgtaattcacacaggcataaaaatgagttcagaatctatttcactaattatttagctgggatttggatttccctgacatgcttaatacaattacaatacctgtgtacaaacagaggcctgaggaaagaggcaaaatttgcttttcatccaaacagcaacaaaaggcagttgaaaccttcaagcctgttggttgcttttaaacctttgtgttattatgatatatattctttgttgagcactgaggtcctgagggatacatatctcttgctgttttctgcctacttttgactagctgtatgtaacaaaggctctacttttgctctgtcactgttcctacagtcctgttctttactagctagattagcctattttgcacctattaaattctaaaaaccttgtttaaaaaaaaaaaaaaaaaa

SEQ ID NO: 586 - protein, 336 aa, Homo Sapien
MDYPTLLLALLHVYRALCEEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 587 - DNA, 2844 bp, Homo Sapien
tagaacaaaggagaagtgcgtcctttcaaattatagattctttgggggaaaagagggacagaactttatctgagtttggaatgagtctgagtagctgcaatagtaaagttgcttccagaagcaggtaaacttgacttcaaaaaaccccgcttcatgaaatattagtgattcacttcagttgctatctgaggaagttctggtagagagaagagctcaagagcatgggcagagtcagctcctgagtgggctgaacgctcccctcagctcctgcagtgctaattaagggagggagcagcggggagcttgcagtgaccaagagggtgttgaggctaggaggccacgataaacaggatacgataaaagtccttaaccaagacgcagatgggaagaagcgttagagcgagcagcactcacatctcaagaaccagcctttcaaacagtttccagagatggattatcctactttacttttggctcttcttcatgtatacagagctctatgtgaagaggtgctttggcatacatcagttccctttgccgagaacatgtctctagaatgtgtgtatccatcaatgggcatcttaacacaggtggagtggttcaagatcgggacccagcaggattccatagccattttcagccctactcatggcatggtcataaggaagccctatgctgagagggtttactttttgaattcaacgatggcttccaataacatgactcttttctttcggaatgcctctgaagatgatgttggctactattcctgctctctttacacttacccacagggaacttggcagaaggtgatacaggtggttcagtcagatagttttgaggcagctgtgccatcaaatagccacattgtttcggaacctggaaagaatgtcacactcacttgtcagcctcagatgacgtggcctgtgcaggcagtgaggtgggaaaagatccagccccgtcagatcgacctcttaacttactgcaacttggtccatggcagaaatttcacctccaagttcccaagacaaatagtgagcaactgcagccacggaaggtggagcgtcatcgtcatccccgatgtcacagtctcagactcggggctttaccgctgctacttgcaggccagcgcaggagaaaacgaaaccttcgtgatgagattgactgtagccgagggtaaaaccgataaccaatataccctctttgtggctggagggacagttttattgttgttgtttgttatctcaattaccaccatcattgtcattttccttaacagaaggagaaggagagagagaagagatctatttacagagtcctgggatacacagaaggcacccaataactatagaagtcccatctctaccagtcaacctaccaatcaatccatggatgatacaagagaggatatttatgtcaactatccaaccttctctcgcagaccaaagactagagtttaagcttattcttgacatgagtgcattagtaatgactcttatgtactcatgcatggatctttatgcaatttttttccactacccaaggtctaccttagatactagttgtctgaattgagttactttgataggaaaaatacttcattacctaaaatcatttttcatagaactgtttcagaaaacctgactctaactggtttatatacaaaagaaaacttactgtatcatataacagaatgatccaggggagattaagctttgggcaagggctatttaccagggcttaaatgttgtgtctagaattaagtatgggcataaactggcttctgaatccctttccagagtgttggatccatttccctggtcttggcctcactctcatgcaggctttcctcttgtgttggcaagatggctgccaactcttggcaattcatacatccttgtttctgtctggtagagagtttgcttctcaaatggagcaaacaaatttgattattttttcattgttaaataggcaacatgaccagaaaggatggaatggcttaagtaaactaagggttcacttctagagctgagaagcagggtcaaagcacaatactgggcaattcagagcatggttagaagaggaaaggggagtctcaaagctggagagtttaccaacaaatattgactgcagtgattaaccaagacatttttgttaactaaaaagtgaaatatgggatggattctagaaatggggtatctctgtccatacttctagaatccactctatcagcatagtccagaagaatacctggcagtagaagaaatgaatattcaagaggaagataaatgcgagagggcaatcctttactattctcatatttatttatctctcattctgtatagaattcttgccgccatcccaggtctagccttaggagcaaatgtagtagatagtcgaataataaataacttaatgttttggacatattttgtctacttttgagaattatttttaatatgtaaattctctcaaaagggtcaggcacctagttattattttttaatgattatgtgaaagttgaatataatataccactaaaagtgacagttgaaagtggtggcataggacggtagggtagaaatttgggagggaaaaaagaaattgggagggtacaggcaacaggagaaaggaatcaaaccacagaaaaatacaaagggaaacttctgcttcactattcagacaaagacagccctaatgacatcaccaacagtcaaagcaattagagaccatacctaatattgtttaaattctagatgtaggctaacaatgaaaagtatttgccaaactgaataaaactgtcatggttaccttgaaaaaaaaaaaaaaaaaaaaaaaaaaaaa

SEQ ID NO: 588 - DNA, 2842 bp, Homo Sapien
atgcatgcaccacctttcacttattatttatatttttacatctttattttagtttctgcctcctccacatagaatgtaagttctatcatggcaatatttttttttttttgtattattgtatcctcattgcctacagctgagttaggcacagagaatgcatgcagcacatgtttgttgaatgaatgactccttgtagaaaatgaaagcccgaaaataagccgactggttccccgagagagaagaaactcaaatctgcccatcctcataaaggagcaaacctgtcttttaagctaaggcctttttcctgtgttcatacttcagaaaaagaagacacgactgataacatctgagaggaaggaaactgcattgtgctggggatctgcatgtcacattataaaaagcaatttttttttttaatagaaccagcctttcaaacagtttccagagatggattatcctactttacttttggctcttcttcatgtatacagagctctatgtgaagaggtgctttggcatacatcagttccctttgccgagaacatgtctctagaatgtgtgtatccatcaatgggcatcttaacacaggtggagtggttcaagatcgggacccagcaggattccatagccattttcagccctactcatggcatggtcataaggaagccctatgctgagagggtttactttttgaattcaacgatggcttccaataacatgactcttttctttcggaatgcctctgaagatgatgttggctactattcctgctctctttacacttacccacagggaacttggcagaaggtgatacaggtggttcagtcagatagttttgaggcagctgtgccatcaaatagccacattgtttcggaacctggaaagaatgtcacactcacttgtcagcctcagatgacgtggcctgtgcaggcagtgaggtgggaaaagatccagccccgtcagatcgacctcttaacttactgcaacttggtccatggcagaaatttcacctccaagttcccaagacaaatagtgagcaactgcagccacggaaggtggagcgtcatcgtcatccccgatgtcacagtctcagactcggggctttaccgctgctacttgcaggccagcgcaggagaaaacgaaaccttcgtgatgagattgactgtagccgagggtaaaaccgataaccaatataccctctttgtggctggagggacagttttattgttgttgtttgttatctcaattaccaccatcattgtcattttccttaacagaaggagaaggagagagagaagagatctatttacagagtcctgggatacacagaaggcacccaataactatagaagtcccatctctaccagtcaacctaccaatcaatccatggatgatacaagagaggatatttatgtcaactatccaaccttctctcgcagaccaaagactagagtttaagcttattcttgacatgagtgcattagtaatgactcttatgtactcatgcatggatctttatgcaatttttttccactacccaaggtctaccttagatactagttgtctgaattgagttactttgataggaaaaatacttcattacctaaaatcatttttcatagaactgtttcagaaaacctgactctaactggtttatatacaaaagaaaacttactgtatcatataacagaatgatccaggggagattaagctttgggcaagggctatttaccagggcttaaatgttgtgtctagaattaagtatgggcataaactggcttctgaatccctttccagagtgttggatccatttccctggtcttggcctcactctcatgcaggctttcctcttgtgttggcaagatggctgccaactcttggcaattcatacatccttgtttctgtctggtagagagtttgcttctcaaatggagcaaacaaatttgattattttttcattgttaaataggcaacatgaccagaaaggatggaatggcttaagtaaactaagggttcacttctagagctgagaagcagggtcaaagcacaatactgggcaattcagagcatggttagaagaggaaaggggagtctcaaagctggagagtttaccaacaaatattgactgcagtgattaaccaagacatttttgttaactaaaaagtgaaatatgggatggattctagaaatggggtatctctgtccatacttctagaatccactctatcagcatagtccagaagaatacctggcagtagaagaaatgaatattcaagaggaagataaatgcgagagggcaatcctttactattctcatatttatttatctctcattctgtatagaattcttgccgccatcccaggtctagccttaggagcaaatgtagtagatagtcgaataataaataacttaatgttttggacatattttgtctacttttgagaattatttttaatatgtaaattctctcaaaagggtcaggcacctagttattattttttaatgattatgtgaaagttgaatataatataccactaaaagtgacagttgaaagtggtggcataggacggtagggtagaaatttgggagggaaaaaagaaattgggagggtacaggcaacaggagaaaggaatcaaaccacagaaaaatacaaagggaaacttctgcttcactattcagacaaagacagccctaatgacatcaccaacagtcaaagcaattagagaccatacctaatattgtttaaattctagatgtaggctaacaatgaaaagtatttgccaaactgaataaaactgtcatggttaccttgaaaaaaaaaaaaaaaaaaaaaaaaaaaaa

SEQ ID NO: 589 - protein, 181 aa, Homo Sapien
MTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 590 - DNA, 2435 bp, Homo Sapien
tagaacaaaggagaagtgcgtcctttcaaattatagattctttgggggaaaagagggacagaactttatctgagtttggaatgagtctgagtagctgcaatagtaaagttgcttccagaagcaggtaaacttgacttcaaaaaaccccgcttcatgaaatattagtgattcacttcagttgctatctgaggaagttctggtagagagaagagctcaagagcatgggcagagtcagctcctgagtgggctgaacgctcccctcagctcctgcagtgctaattaagggagggagcagcggggagcttgcagtgaccaagagggtgttgaggctaggaggccacgataaacaggatacgataaaagtccttaaccaagacgcagatgggaagaagcgttagagcgagcagcactcacatctcaagatagttttgaggcagctgtgccatcaaatagccacattgtttcggaacctggaaagaatgtcacactcacttgtcagcctcagatgacgtggcctgtgcaggcagtgaggtgggaaaagatccagccccgtcagatcgacctcttaacttactgcaacttggtccatggcagaaatttcacctccaagttcccaagacaaatagtgagcaactgcagccacggaaggtggagcgtcatcgtcatccccgatgtcacagtctcagactcggggctttaccgctgctacttgcaggccagcgcaggagaaaacgaaaccttcgtgatgagattgactgtagccgagggtaaaaccgataaccaatataccctctttgtggctggagggacagttttattgttgttgtttgttatctcaattaccaccatcattgtcattttccttaacagaaggagaaggagagagagaagagatctatttacagagtcctgggatacacagaaggcacccaataactatagaagtcccatctctaccagtcaacctaccaatcaatccatggatgatacaagagaggatatttatgtcaactatccaaccttctctcgcagaccaaagactagagtttaagcttattcttgacatgagtgcattagtaatgactcttatgtactcatgcatggatctttatgcaatttttttccactacccaaggtctaccttagatactagttgtctgaattgagttactttgataggaaaaatacttcattacctaaaatcatttttcatagaactgtttcagaaaacctgactctaactggtttatatacaaaagaaaacttactgtatcatataacagaatgatccaggggagattaagctttgggcaagggctatttaccagggcttaaatgttgtgtctagaattaagtatgggcataaactggcttctgaatccctttccagagtgttggatccatttccctggtcttggcctcactctcatgcaggctttcctcttgtgttggcaagatggctgccaactcttggcaattcatacatccttgtttctgtctggtagagagtttgcttctcaaatggagcaaacaaatttgattattttttcattgttaaataggcaacatgaccagaaaggatggaatggcttaagtaaactaagggttcacttctagagctgagaagcagggtcaaagcacaatactgggcaattcagagcatggttagaagaggaaaggggagtctcaaagctggagagtttaccaacaaatattgactgcagtgattaaccaagacatttttgttaactaaaaagtgaaatatgggatggattctagaaatggggtatctctgtccatacttctagaatccactctatcagcatagtccagaagaatacctggcagtagaagaaatgaatattcaagaggaagataaatgcgagagggcaatcctttactattctcatatttatttatctctcattctgtatagaattcttgccgccatcccaggtctagccttaggagcaaatgtagtagatagtcgaataataaataacttaatgttttggacatattttgtctacttttgagaattatttttaatatgtaaattctctcaaaagggtcaggcacctagttattattttttaatgattatgtgaaagttgaatataatataccactaaaagtgacagttgaaagtggtggcataggacggtagggtagaaatttgggagggaaaaaagaaattgggagggtacaggcaacaggagaaaggaatcaaaccacagaaaaatacaaagggaaacttctgcttcactattcagacaaagacagccctaatgacatcaccaacagtcaaagcaattagagaccatacctaatattgtttaaattctagatgtaggctaacaatgaaaagtatttgccaaactgaataaaactgtcatggttaccttgaaaaaaaaaaaaaaaaaaaaaaaaaaaaa

SEQ ID NO: 591 - protein, 585 aa, Homo Sapien
MEKKWKYCAVYYIIQIHFVKGVWEKTVNTEENVYATLGSDVNLTCQTQTVGFFVQMQWSKVTNKIDLIAVYHPQYGFYCAYGRPCESLVTFTETPENGSKWTLHLRNMSCSVSGRYECMLVLYPEGIQTKIYNLLIQTHVTADEWNSNHTIEIEINQTLEIPCFQNSSSKISSEFTYAWSVENSSTDSWVLLSKGIKEDNGTQETLISQNHLISNSTLLKDRVKLGTDYRLHLSPVQIFDDGRKFSCHIRVGPNKILRSSTTVKVFAKPEIPVIVENNSTDVLVERRFTCLLKNVFPKANITWFIDGSFLHDEKEGIYITNEERKGKDGFLELKSVLTRVHSNKPAQSDNLTIWCMALSPVPGNKVWNISSEKITFLLGSEISSTDPPLSVTESTLDTQPSPASSVSPARYPATSSVTLVDVSALRPNTTPQPSNSSMTTRGFNYPWTSSGTDTKKSVSRIPSETYSSSPSGAGSTLHDNVFTSTARAFSEVPTTANGSTKTNHVHITGIVVNKPKDGMSWPVIVAALLFCCMILFGLGVRKWCQYQKEIMERPPPFKPPPPPIKYTCIQEPNESDLPYHEMETL

SEQ ID NO: 592 - DNA, 4481 bp, Homo Sapien
ttcctgtctacgtttcatttcctgggggcttgccaagtgataaacagacccaggcgtgtgtggtagagttcgggttttttagcacgaagtgggtggctggagtttgcttgaaaacatcaattgactttgtgatcattacagaaatgctggtgtaaggtgttcagaagacaatggagaaaaaatggaaatactgtgctgtctattacatcatccagatacattttgtcaagggagtttgggaaaaaacagtcaacacagaagaaaatgtttatgctacacttggctctgatgtcaacctgacctgccaaacacagacagtaggcttcttcgtgcagatgcaatggtccaaggtcaccaataagatagacctgattgctgtctatcatccccaatacggcttctactgtgcctatgggagaccctgtgagtcacttgtgactttcacagaaactcctgagaatgggtcaaaatggactctgcacttaaggaatatgtcttgttcagtcagtggaaggtacgagtgtatgcttgttctgtatccagagggcattcagactaaaatctacaaccttctcattcagacacacgttacagcagatgaatggaacagcaaccatacgatagaaatagagataaatcagactctggaaataccatgctttcaaaatagctcctcaaaaatttcatctgagttcacctatgcatggtcggtggaaaacagcagcacggattcttgggtccttctttctaagggtataaaggaggataatggaactcaggaaacacttatctcccaaaatcacctcatcagcaattccacattacttaaagatagagtcaagcttggtacagactacagactccacctctctccagtccaaatcttcgatgatgggcggaagttctcttgccacattagagtcggtcctaacaaaatcttgaggagctccaccacagtcaaggtttttgctaaaccagaaatccctgtgattgtggaaaataactccacggatgtcttggtagagagaagatttacctgcttactaaagaatgtatttcccaaagcaaatatcacatggtttatagatggaagttttcttcatgatgaaaaagaaggaatatatattactaatgaagagagaaaaggcaaagatggatttttggaactgaagtctgttttaacaagggtacatagtaataaaccagcccaatcagacaacttgaccatttggtgtatggctctgtctccagtcccaggaaataaagtgtggaacatctcatcagaaaagatcacttttctcttaggttctgaaatttcctcaacagaccctccactgagtgttacagaatctacccttgacacccaaccttctccagccagcagtgtatctcctgcaagatatccagctacatcttcagtgacccttgtagatgtgagtgccttgaggccaaacaccactcctcaacccagcaattccagtatgactacccgaggcttcaactatccctggacctccagtgggacagataccaaaaaatcagtttcacggatacctagtgaaacatacagttcatccccgtcaggtgcaggctcaacacttcatgacaatgtctttaccagcacagccagagcattttcagaagtccccacaactgccaatggatctacgaaaactaatcacgtccatatcactggtattgtggtcaataagcccaaagatggaatgtcctggccagtgattgtagcagctttactcttttgctgcatgatattgtttggtcttggagtgagaaaatggtgtcagtaccaaaaagaaataatggaaagacctccacctttcaagccaccaccacctcccatcaagtacacttgcattcaagagcccaacgaaagtgatctgccttatcatgagatggagaccctctagtctcgtgagactttgccccatggcagaactctgctggaatcctattgagaaggtagacattgtgctttattaatatagtcgctcttcagccatgcctttgctgcagctgaaatggaagtcagaagtgagtgacctgttttcccagcaactcaccctcttccatctccaaacgcctgaagcttaaccaagagtgagaggatatgtcatgttcacactcaatgcaattcgtagtggttttcttgcttatgtaagaagtacatattagtctgccatctttaaaaaaaaatacagtattttcatttaaattctctgatggagggacaacaatggtttcaactgtatgcccatgcctgatcctcttatttgaacatctatcaacattgtaaactctttgccaaaatcctggggctttgctgcattccctaagataattacaggaaaaagaaaatgtaaaagtgctaacaaggctgccaagtaatggagaagtatggttagtcttcatattgaaattctgttgcttattttcatggaaggaaacagaatactttgcacaggaaccacattttcaatcctccttcactgtcttcctaccatgttcagcccagactcctgccacatggaccaggatgaagagggatcaaagagataattagccaaaaacccagtagcctagaagatacaaaactccactggcctctaaaattatattagccaagagtggtttcatttgagtgccttcgtgtgtatgtccatcaaactggaaccaaactgttttgtaagtaaacaggcagcctaagcccaaccctactttctaattccagttattctctttttcatctggggatttacctgttcatttaatctgcctgttttgatctgttttgaaaaagataaagagcctcaaatcagaccagcactgattaattaaccctgctcctaccaatcttttttaaagcagttgaagcagaatgtataggtgtcagagaagaaacctagtcagccagacgtgctctgtattcagcaatagtttgtgaatgaataaattactaatcctccttgtcgcttgaaaccttcccacactccctgctccaggagggaaaaacagatgttgttgacagatagagtgataggcaaattctgtgtggactttagtcccaaaaggaaactttagttcacttgcagtatgcttatccttgactgcacatgagaatgccttgtgcagagttatttggagattatgtctttttcttaaacaccatggctgtcacacttcagttcaattaaatcagaatgtctgaggagtgagacacaggcatcaacactctcaaatgattcacatgttcagccaaagttgagaaccatcgagcctgtggaagttctttctcatggctcagaatcttaggtaggtgcttaactcttgtggtggccagcctccaagatgagccccagtgttcttgcctcctactattcacatctttatgtggtcccctccaatgctgaatacagatgatttgtgtaacctgaggccaggattaaggggaggcaatcaatgcacctagggaaaaaatttaaggaggtattcacactcagggtcatgcacttgcacaatgttgagaatgagtaccactctcaccattggtatagccaaaaaagcttggaagtgaccaaggctaggtcacaaaatacactgtggcttcttctttgatctctctttgaccatactgacactgggaaaagcccattcccatgccatgaagacaccaaggcagccctattgagaaatctacctgtcgtggccgggcgcagtggctcacgcctgtaatcccagcactttgggaggccgaggtgggtggatcacgaggtcaggagatcgagaccatcctggctaacacagtgaaaccccgtctctactaaaaatacaaaaaattagccgggtgtggtgtcgggcacctgtagtcccagctactcaggaggctgaggcaggagaagggtgggaacccgggaggcagagcttgcagtgagccgagattgtgccactgcacactccaatctgggtgaaagaccgagactccgcctcaaaaaaaaaaaaaaaagaaagaaagaaagaaagaaagaaatctacctgtcaaggaactaaggtattttgctaacaagcaccaacttgccagccatgtaagggagccatcttggaagcagatcctccagcctccagtcaagtcttcagataattgcaacttcagttgatcttttgaccaagacctcaagagagccagaactacccagctaagccttttactaaatttctgaacttctaacactattagataataagtgcttattgtttaacaccattaattttgagtataatttgttacatagcgacagataactatacagctcaacaactagaaaaataaactgtttacctgccttaattatttatctttagttccttattagttctcaagaaacaaatgctagcttcatatgtatggctgttgctttgcttcatgtgtatggctatttgtatttaacaagacttaatcatcagta

SEQ ID NO: 593 - protein, 569 aa, Homo Sapien
MEKKWKYCAVYYIIQIHFVKGVWEKTVNTEENVYATLGSDVNLTCQTQTVGFFVQMQWSKVTNKIDLIAVYHPQYGFYCAYGRPCESLVTFTETPENGSKWTLHLRNMSCSVSGRYECMLVLYPEGIQTKIYNLLIQTHVTADEWNSNHTIEIEINQTLEIPCFQNSSSKISSEFTYAWSVEDNGTQETLISQNHLISNSTLLKDRVKLGTDYRLHLSPVQIFDDGRKFSCHIRVGPNKILRSSTTVKVFAKPEIPVIVENNSTDVLVERRFTCLLKNVFPKANITWFIDGSFLHDEKEGIYITNEERKGKDGFLELKSVLTRVHSNKPAQSDNLTIWCMALSPVPGNKVWNISSEKITFLLGSEISSTDPPLSVTESTLDTQPSPASSVSPARYPATSSVTLVDVSALRPNTTPQPSNSSMTTRGFNYPWTSSGTDTKKSVSRIPSETYSSSPSGAGSTLHDNVFTSTARAFSEVPTTANGSTKTNHVHITGIVVNKPKDGMSWPVIVAALLFCCMILFGLGVRKWCQYQKEIMERPPPFKPPPPPIKYTCIQEPNESDLPYHEMETL

SEQ ID NO: 594 - DNA, 4433 bp, Homo Sapien
ttcctgtctacgtttcatttcctgggggcttgccaagtgataaacagacccaggcgtgtgtggtagagttcgggttttttagcacgaagtgggtggctggagtttgcttgaaaacatcaattgactttgtgatcattacagaaatgctggtgtaaggtgttcagaagacaatggagaaaaaatggaaatactgtgctgtctattacatcatccagatacattttgtcaagggagtttgggaaaaaacagtcaacacagaagaaaatgtttatgctacacttggctctgatgtcaacctgacctgccaaacacagacagtaggcttcttcgtgcagatgcaatggtccaaggtcaccaataagatagacctgattgctgtctatcatccccaatacggcttctactgtgcctatgggagaccctgtgagtcacttgtgactttcacagaaactcctgagaatgggtcaaaatggactctgcacttaaggaatatgtcttgttcagtcagtggaaggtacgagtgtatgcttgttctgtatccagagggcattcagactaaaatctacaaccttctcattcagacacacgttacagcagatgaatggaacagcaaccatacgatagaaatagagataaatcagactctggaaataccatgctttcaaaatagctcctcaaaaatttcatctgagttcacctatgcatggtcggtggaggataatggaactcaggaaacacttatctcccaaaatcacctcatcagcaattccacattacttaaagatagagtcaagcttggtacagactacagactccacctctctccagtccaaatcttcgatgatgggcggaagttctcttgccacattagagtcggtcctaacaaaatcttgaggagctccaccacagtcaaggtttttgctaaaccagaaatccctgtgattgtggaaaataactccacggatgtcttggtagagagaagatttacctgcttactaaagaatgtatttcccaaagcaaatatcacatggtttatagatggaagttttcttcatgatgaaaaagaaggaatatatattactaatgaagagagaaaaggcaaagatggatttttggaactgaagtctgttttaacaagggtacatagtaataaaccagcccaatcagacaacttgaccatttggtgtatggctctgtctccagtcccaggaaataaagtgtggaacatctcatcagaaaagatcacttttctcttaggttctgaaatttcctcaacagaccctccactgagtgttacagaatctacccttgacacccaaccttctccagccagcagtgtatctcctgcaagatatccagctacatcttcagtgacccttgtagatgtgagtgccttgaggccaaacaccactcctcaacccagcaattccagtatgactacccgaggcttcaactatccctggacctccagtgggacagataccaaaaaatcagtttcacggatacctagtgaaacatacagttcatccccgtcaggtgcaggctcaacacttcatgacaatgtctttaccagcacagccagagcattttcagaagtccccacaactgccaatggatctacgaaaactaatcacgtccatatcactggtattgtggtcaataagcccaaagatggaatgtcctggccagtgattgtagcagctttactcttttgctgcatgatattgtttggtcttggagtgagaaaatggtgtcagtaccaaaaagaaataatggaaagacctccacctttcaagccaccaccacctcccatcaagtacacttgcattcaagagcccaacgaaagtgatctgccttatcatgagatggagaccctctagtctcgtgagactttgccccatggcagaactctgctggaatcctattgagaaggtagacattgtgctttattaatatagtcgctcttcagccatgcctttgctgcagctgaaatggaagtcagaagtgagtgacctgttttcccagcaactcaccctcttccatctccaaacgcctgaagcttaaccaagagtgagaggatatgtcatgttcacactcaatgcaattcgtagtggttttcttgcttatgtaagaagtacatattagtctgccatctttaaaaaaaaatacagtattttcatttaaattctctgatggagggacaacaatggtttcaactgtatgcccatgcctgatcctcttatttgaacatctatcaacattgtaaactctttgccaaaatcctggggctttgctgcattccctaagataattacaggaaaaagaaaatgtaaaagtgctaacaaggctgccaagtaatggagaagtatggttagtcttcatattgaaattctgttgcttattttcatggaaggaaacagaatactttgcacaggaaccacattttcaatcctccttcactgtcttcctaccatgttcagcccagactcctgccacatggaccaggatgaagagggatcaaagagataattagccaaaaacccagtagcctagaagatacaaaactccactggcctctaaaattatattagccaagagtggtttcatttgagtgccttcgtgtgtatgtccatcaaactggaaccaaactgttttgtaagtaaacaggcagcctaagcccaaccctactttctaattccagttattctctttttcatctggggatttacctgttcatttaatctgcctgttttgatctgttttgaaaaagataaagagcctcaaatcagaccagcactgattaattaaccctgctcctaccaatcttttttaaagcagttgaagcagaatgtataggtgtcagagaagaaacctagtcagccagacgtgctctgtattcagcaatagtttgtgaatgaataaattactaatcctccttgtcgcttgaaaccttcccacactccctgctccaggagggaaaaacagatgttgttgacagatagagtgataggcaaattctgtgtggactttagtcccaaaaggaaactttagttcacttgcagtatgcttatccttgactgcacatgagaatgccttgtgcagagttatttggagattatgtctttttcttaaacaccatggctgtcacacttcagttcaattaaatcagaatgtctgaggagtgagacacaggcatcaacactctcaaatgattcacatgttcagccaaagttgagaaccatcgagcctgtggaagttctttctcatggctcagaatcttaggtaggtgcttaactcttgtggtggccagcctccaagatgagccccagtgttcttgcctcctactattcacatctttatgtggtcccctccaatgctgaatacagatgatttgtgtaacctgaggccaggattaaggggaggcaatcaatgcacctagggaaaaaatttaaggaggtattcacactcagggtcatgcacttgcacaatgttgagaatgagtaccactctcaccattggtatagccaaaaaagcttggaagtgaccaaggctaggtcacaaaatacactgtggcttcttctttgatctctctttgaccatactgacactgggaaaagcccattcccatgccatgaagacaccaaggcagccctattgagaaatctacctgtcgtggccgggcgcagtggctcacgcctgtaatcccagcactttgggaggccgaggtgggtggatcacgaggtcaggagatcgagaccatcctggctaacacagtgaaaccccgtctctactaaaaatacaaaaaattagccgggtgtggtgtcgggcacctgtagtcccagctactcaggaggctgaggcaggagaagggtgggaacccgggaggcagagcttgcagtgagccgagattgtgccactgcacactccaatctgggtgaaagaccgagactccgcctcaaaaaaaaaaaaaaaagaaagaaagaaagaaagaaagaaatctacctgtcaaggaactaaggtattttgctaacaagcaccaacttgccagccatgtaagggagccatcttggaagcagatcctccagcctccagtcaagtcttcagataattgcaacttcagttgatcttttgaccaagacctcaagagagccagaactacccagctaagccttttactaaatttctgaacttctaacactattagataataagtgcttattgtttaacaccattaattttgagtataatttgttacatagcgacagataactatacagctcaacaactagaaaaataaactgtttacctgccttaattatttatctttagttccttattagttctcaagaaacaaatgctagcttcatatgtatggctgttgctttgcttcatgtgtatggctatttgtatttaacaagacttaatcatcagta

SEQ ID NO: 595 - protein, 402 aa, Homo Sapien
MEKKWKYCAVYYIIQIHFVKGVWEKTVNTEENVYATLGSDVNLTCQTQTVGFFVQMQWSKVTNKIDLIAVYHPQYGFYCAYGRPCESLVTFTETPENGSKWTLHLRNMSCSVSGRYECMLVLYPEGIQTKIYNLLIQTHVTADEWNSNHTIEIEINQTLEIPCFQNSSSKISSEFTYAWSVEDNGTQETLISQNHLISNSTLLKDRVKLGTDYRLHLSPVQIFDDGRKFSCHIRVGPNKILRSSTTVKVFAKPEIPVIVENNSTDVLVERRFTCLLKNVFPKANITWFIDGSFLHDEKEGIYITNEERKGKDGFLELKSVLTRVHSNKPAQSDNLTIWCMALSPVPGNKVWNISSEKITFLLGSEISSTDPPLSVTESTLDTQPSPASSVSPASKNVFTLSY

SEQ ID NO: 596 - DNA, 1651 bp, Homo Sapien
ttcctgtctacgtttcatttcctgggggcttgccaagtgataaacagacccaggcgtgtgtggtagagttcgggttttttagcacgaagtgggtggctggagtttgcttgaaaacatcaattgactttgtgatcattacagaaatgctggtgtaaggtgttcagaagacaatggagaaaaaatggaaatactgtgctgtctattacatcatccagatacattttgtcaagggagtttgggaaaaaacagtcaacacagaagaaaatgtttatgctacacttggctctgatgtcaacctgacctgccaaacacagacagtaggcttcttcgtgcagatgcaatggtccaaggtcaccaataagatagacctgattgctgtctatcatccccaatacggcttctactgtgcctatgggagaccctgtgagtcacttgtgactttcacagaaactcctgagaatgggtcaaaatggactctgcacttaaggaatatgtcttgttcagtcagtggaaggtacgagtgtatgcttgttctgtatccagagggcattcagactaaaatctacaaccttctcattcagacacacgttacagcagatgaatggaacagcaaccatacgatagaaatagagataaatcagactctggaaataccatgctttcaaaatagctcctcaaaaatttcatctgagttcacctatgcatggtcggtggaggataatggaactcaggaaacacttatctcccaaaatcacctcatcagcaattccacattacttaaagatagagtcaagcttggtacagactacagactccacctctctccagtccaaatcttcgatgatgggcggaagttctcttgccacattagagtcggtcctaacaaaatcttgaggagctccaccacagtcaaggtttttgctaaaccagaaatccctgtgattgtggaaaataactccacggatgtcttggtagagagaagatttacctgcttactaaagaatgtatttcccaaagcaaatatcacatggtttatagatggaagttttcttcatgatgaaaaagaaggaatatatattactaatgaagagagaaaaggcaaagatggatttttggaactgaagtctgttttaacaagggtacatagtaataaaccagcccaatcagacaacttgaccatttggtgtatggctctgtctccagtcccaggaaataaagtgtggaacatctcatcagaaaagatcacttttctcttaggttctgaaatttcctcaacagaccctccactgagtgttacagaatctacccttgacacccaaccttctccagccagcagtgtatctcctgcaagtaagaatgttttcacactgagctattgatttaaccaagcagattgataacgataaaatttcagcaaacttgcatcattcatgcctgtttcttagctatgacttttttggggctgaaattgggttttattttttaacagctttattgagatataattcacgtcacattaacttgcccatttaaaatgtatgatctaatggtttttagtatgttcacagacttgtacaaccatgactacagccaatttcagaacattttcatcatctaataaagaaactcctaaacaaaaaaaaaaaaaaaa

SEQ ID NO: 597 - protein, 8 aa, Homo Sapien
GFTFDDYG

SEQ ID NO: 598 - protein, 8 aa, Homo Sapien
ISWNSVTI

SEQ ID NO: 599 - protein, 14 aa, Homo Sapien
AKDGGLRYYYGMDV

SEQ ID NO: 600 - protein, 5 aa, Homo Sapien
DYGMY

SEQ ID NO: 601 - protein, 17 aa, Homo Sapien
GISWNSVTIGYADSVKG

SEQ ID NO: 602 - protein, 12 aa, Homo Sapien
DGGLRYYYGMDV

SEQ ID NO: 603 - protein, 121 aa, Homo Sapien
EVQLVESGGGLVQPGRSLRLSCAASGFTFDDYGMYWVRQTPGKGLEWVSGISWNSVTIGYADSVKGRFTISRDNAKNSLYLQMNSLRAEDTALYYCAKDGGLRYYYGMDVWGQGTKVTVSS

SEQ ID NO: 604 - DNA, 363 bp, Homo Sapien
gaagtgcagctggtggagtctgggggaggcttggtacagcctggcaggtccctgagactctcctgtgcagcctctggattcacctttgatgattatggcatgtactgggtccggcaaactccagggaagggcctggagtgggtctcaggtattagttggaatagtgttaccataggctatgcggactctgtgaagggccgattcaccatctccagagacaacgccaagaactccctgtatctgcaaatgaacagtctgagagctgaggacacggccttgtattactgtgcaaaagatggtggcttgaggtattactacggtatggacgtctggggccaagggaccaaggtcaccgtctcctca

SEQ ID NO: 605 - protein, 448 aa, Homo Sapien
EVQLVESGGGLVQPGRSLRLSCAASGFTFDDYGMYWVRQTPGKGLEWVSGISWNSVTIGYADSVKGRFTISRDNAKNSLYLQMNSLRAEDTALYYCAKDGGLRYYYGMDVWGQGTKVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 606 - DNA, 1344 bp, Homo Sapien
gaagtgcagctggtggagtctgggggaggcttggtacagcctggcaggtccctgagactctcctgtgcagcctctggattcacctttgatgattatggcatgtactgggtccggcaaactccagggaagggcctggagtgggtctcaggtattagttggaatagtgttaccataggctatgcggactctgtgaagggccgattcaccatctccagagacaacgccaagaactccctgtatctgcaaatgaacagtctgagagctgaggacacggccttgtattactgtgcaaaagatggtggcttgaggtattactacggtatggacgtctggggccaagggaccaaggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 607 - protein, 11 aa, Homo Sapien
QSLLHSNGYNY

SEQ ID NO: 608 - protein, 3 aa, Homo Sapien
LDS

SEQ ID NO: 609 - protein, 9 aa, Homo Sapien
MQALRTPLT

SEQ ID NO: 610 - protein, 16 aa, Homo Sapien
RSSQSLLHSNGYNYLA

SEQ ID NO: 611 - protein, 7 aa, Homo Sapien
LDSNRAS

SEQ ID NO: 612 - protein, 9 aa, Homo Sapien
MQALRTPLT

SEQ ID NO: 613 - protein, 112 aa, Homo Sapien
DIVMTQSPLSLSVTPGESASISCRSSQSLLHSNGYNYLAWYLQKPGQSPQLLIYLDSNRASGVPDRFSGSGSGTDFTLKISRVEAEDVGIYYCMQALRTPLTFGGGTKVEIK

SEQ ID NO: 614 - DNA, 336 bp, Homo Sapien
gatattgtgatgactcagtctccactctccctgtccgtcacccctggagagtcggcctccatctcctgcaggtctagtcagagcctcctgcatagtaatggatacaactatttggcttggtacctgcagaagccagggcagtctccacagctcctgatctatttggattctaatcgggcctccggggtccctgacaggttcagtggcagtggatcaggcacagattttacactgaaaatcagcagagtggaggctgaggatgttgggatttattactgcatgcaagctctgcgaactccgctcactttcggcggagggaccaaggtggagatcaaa

SEQ ID NO: 615 - protein, 219 aa, Homo Sapien
DIVMTQSPLSLSVTPGESASISCRSSQSLLHSNGYNYLAWYLQKPGQSPQLLIYLDSNRASGVPDRFSGSGSGTDFTLKISRVEAEDVGIYYCMQALRTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 616 - DNA, 657 bp, Homo Sapien
gatattgtgatgactcagtctccactctccctgtccgtcacccctggagagtcggcctccatctcctgcaggtctagtcagagcctcctgcatagtaatggatacaactatttggcttggtacctgcagaagccagggcagtctccacagctcctgatctatttggattctaatcgggcctccggggtccctgacaggttcagtggcagtggatcaggcacagattttacactgaaaatcagcagagtggaggctgaggatgttgggatttattactgcatgcaagctctgcgaactccgctcactttcggcggagggaccaaggtggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 617 - protein, 8 aa, Homo Sapien
GFTFSDYY

SEQ ID NO: 618 - protein, 8 aa, Homo Sapien
ISSSGSTV

SEQ ID NO: 619 - protein, 14 aa, Homo Sapien
ARDRGFGESYCFDY

SEQ ID NO: 620 - protein, 5 aa, Homo Sapien
DYYMS

SEQ ID NO: 621 - protein, 17 aa, Homo Sapien
YISSSGSTVYSADSVKG

SEQ ID NO: 622 - protein, 12 aa, Homo Sapien
DRGFGESYCFDY

SEQ ID NO: 623 - protein, 121 aa, Homo Sapien
QVPLVESGGGLVRPGGSLRLSCAASGFTFSDYYMSWIRQAPGKGLEWVSYISSSGSTVYSADSVKGRFTVSRDNAKSSLLLHMNSLRAEDTAIYYCARDRGFGESYCFDYWGQGTLVTVSS

SEQ ID NO: 624 - DNA, 363 bp, Homo Sapien
caggtgccgctggtggagtctgggggaggcttggtcaggcctggagggtccctgagactctcctgtgcagcctctggattcaccttcagtgactactacatgagctggatccgccaggctccagggaaggggctggagtgggtttcatacattagtagtagtggtagtaccgtgtattccgcagactctgtgaagggccgattcaccgtctccagggacaacgccaagagctcactgcttctgcacatgaacagcctgagagccgaggacacggccatatattactgtgcgagagatagagggttcggggagtcctattgctttgactactggggccagggaaccctggtcaccgtctcctca

SEQ ID NO: 625 - protein, 448 aa, Homo Sapien
QVPLVESGGGLVRPGGSLRLSCAASGFTFSDYYMSWIRQAPGKGLEWVSYISSSGSTVYSADSVKGRFTVSRDNAKSSLLLHMNSLRAEDTAIYYCARDRGFGESYCFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 626 - DNA, 1344 bp, Homo Sapien
caggtgccgctggtggagtctgggggaggcttggtcaggcctggagggtccctgagactctcctgtgcagcctctggattcaccttcagtgactactacatgagctggatccgccaggctccagggaaggggctggagtgggtttcatacattagtagtagtggtagtaccgtgtattccgcagactctgtgaagggccgattcaccgtctccagggacaacgccaagagctcactgcttctgcacatgaacagcctgagagccgaggacacggccatatattactgtgcgagagatagagggttcggggagtcctattgctttgactactggggccagggaaccctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 627 - protein, 6 aa, Homo Sapien
QNIRSY

SEQ ID NO: 628 - protein, 3 aa, Homo Sapien
TAS

SEQ ID NO: 629 - protein, 9 aa, Homo Sapien
QQSYSIPCS

SEQ ID NO: 630 - protein, 11 aa, Homo Sapien
RASQNIRSYLT

SEQ ID NO: 631 - protein, 7 aa, Homo Sapien
TASSLQS

SEQ ID NO: 632 - protein, 9 aa, Homo Sapien
QQSYSIPCS

SEQ ID NO: 633 - protein, 107 aa, Homo Sapien
DIQMTQSPSSLSASVGDRVTITCRASQNIRSYLTWYQQKPGKAPKLLIYTASSLQSGVPSRFSGSGSGTDFTLTISSLQPEDFATYYCQQSYSIPCSFGQGTKLEIK

SEQ ID NO: 634 - DNA, 321 bp, Homo Sapien
gacatccagatgacccagtctccatcctccctgtctgcatctgtaggagacagagtcaccatcacttgccgggcaagtcagaacattaggagttatttaacttggtatcagcagaaaccagggaaagcccctaagctcctgatctatactgcatccagtttacaaagtggggtcccatcaaggttcagtggcagtggatctgggacagatttcactctcaccatcagcagtctgcaacctgaagattttgcaacttattactgtcaacagagttacagtatcccgtgcagttttggccaggggaccaagctggagatcaaa

SEQ ID NO: 635 - protein, 214 aa, Homo Sapien
DIQMTQSPSSLSASVGDRVTITCRASQNIRSYLTWYQQKPGKAPKLLIYTASSLQSGVPSRFSGSGSGTDFTLTISSLQPEDFATYYCQQSYSIPCSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 636 - DNA, 642 bp, Homo Sapien
gacatccagatgacccagtctccatcctccctgtctgcatctgtaggagacagagtcaccatcacttgccgggcaagtcagaacattaggagttatttaacttggtatcagcagaaaccagggaaagcccctaagctcctgatctatactgcatccagtttacaaagtggggtcccatcaaggttcagtggcagtggatctgggacagatttcactctcaccatcagcagtctgcaacctgaagattttgcaacttattactgtcaacagagttacagtatcccgtgcagttttggccaggggaccaagctggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 637 - protein, 8 aa, Homo Sapien
GFTFSNAW

SEQ ID NO: 638 - protein, 10 aa, Homo Sapien
IKSKANGGTT

SEQ ID NO: 639 - protein, 12 aa, Homo Sapien
VIDPLYDILTGY

SEQ ID NO: 640 - protein, 5 aa, Homo Sapien
NAWMS

SEQ ID NO: 641 - protein, 19 aa, Homo Sapien
RIKSKANGGTTDYAAPVKG

SEQ ID NO: 642 - protein, 10 aa, Homo Sapien
DPLYDILTGY

SEQ ID NO: 643 - protein, 121 aa, Homo Sapien
EVQLVESGGDLVKPGGSLRLSCAASGFTFSNAWMSWVRQAPGKGLEWVGRIKSKANGGTTDYAAPVKGSFTISRDDSKNTLYLQMSSLKTEDTAVYYCVIDPLYDILTGYWGRGTLVTVSS

SEQ ID NO: 644 - DNA, 363 bp, Homo Sapien
gaggtgcagctggtggagtctgggggagacttggtcaagcctggggggtcccttagactctcctgtgcagcctctggattcactttcagtaacgcctggatgagctgggtccgccaggctccagggaaggggctggagtgggttggccgtattaaaagcaaagctaatggtggaacaacagactacgctgcacccgtgaaaggcagtttcaccatctcaagagatgattcaaaaaacacgctgtatctgcaaatgagcagcctgaaaaccgaggacacagccgtgtattattgtgttatagaccccctttacgatattttgactggatactggggccggggaaccctggtcaccgtctcctca

SEQ ID NO: 645 - protein, 448 aa, Homo Sapien
EVQLVESGGDLVKPGGSLRLSCAASGFTFSNAWMSWVRQAPGKGLEWVGRIKSKANGGTTDYAAPVKGSFTISRDDSKNTLYLQMSSLKTEDTAVYYCVIDPLYDILTGYWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 646 - DNA, 1344 bp, Homo Sapien
gaggtgcagctggtggagtctgggggagacttggtcaagcctggggggtcccttagactctcctgtgcagcctctggattcactttcagtaacgcctggatgagctgggtccgccaggctccagggaaggggctggagtgggttggccgtattaaaagcaaagctaatggtggaacaacagactacgctgcacccgtgaaaggcagtttcaccatctcaagagatgattcaaaaaacacgctgtatctgcaaatgagcagcctgaaaaccgaggacacagccgtgtattattgtgttatagaccccctttacgatattttgactggatactggggccggggaaccctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 647 - protein, 6 aa, Homo Sapien
KLGDKY

SEQ ID NO: 648 - protein, 3 aa, Homo Sapien
QDS

SEQ ID NO: 649 - protein, 9 aa, Homo Sapien
QAWDSSTAV

SEQ ID NO: 650 - protein, 11 aa, Homo Sapien
SGDKLGDKYAC

SEQ ID NO: 651 - protein, 7 aa, Homo Sapien
QDSKRPS

SEQ ID NO: 652 - protein, 9 aa, Homo Sapien
QAWDSSTAV

SEQ ID NO: 653 - protein, 106 aa, Homo Sapien
SYDLTQPPSVSVSPGQTASITCSGDKLGDKYACWYQQKPGQSPVLVIYQDSKRPSGIPERFSGSNSGNTATLTISGTQAMDEADYYCQAWDSSTAVFGGGTKLTVL

SEQ ID NO: 654 - DNA, 318 bp, Homo Sapien
tcctatgacctgactcagccaccctcagtgtccgtgtccccaggacagacagccagcatcacctgctctggagataaattgggggataaatatgcttgttggtatcagcagaagccaggccagtcccctgtgctggtcatctatcaagatagtaagcggccctcagggatccctgagcgattctctggctccaattctgggaacacagccactctgaccatcagcgggacccaggctatggatgaggctgactattactgtcaggcgtgggacagcagcactgcggttttcggcggagggaccaagctgaccgtccta

SEQ ID NO: 655 - protein, 212 aa, Homo Sapien
SYDLTQPPSVSVSPGQTASITCSGDKLGDKYACWYQQKPGQSPVLVIYQDSKRPSGIPERFSGSNSGNTATLTISGTQAMDEADYYCQAWDSSTAVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 656 - DNA, 636 bp, Homo Sapien
tcctatgacctgactcagccaccctcagtgtccgtgtccccaggacagacagccagcatcacctgctctggagataaattgggggataaatatgcttgttggtatcagcagaagccaggccagtcccctgtgctggtcatctatcaagatagtaagcggccctcagggatccctgagcgattctctggctccaattctgggaacacagccactctgaccatcagcgggacccaggctatggatgaggctgactattactgtcaggcgtgggacagcagcactgcggttttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 657 - protein, 9 aa, Homo Sapien
GDSISSSNW

SEQ ID NO: 658 - protein, 7 aa, Homo Sapien
IYHSGNT

SEQ ID NO: 659 - protein, 19 aa, Homo Sapien
ARARVYDILTGRGYYGMDV

SEQ ID NO: 660 - protein, 6 aa, Homo Sapien
SSNWWS

SEQ ID NO: 661 - protein, 16 aa, Homo Sapien
EIYHSGNTNYNPSLKS

SEQ ID NO: 662 - protein, 17 aa, Homo Sapien
ARVYDILTGRGYYGMDV

SEQ ID NO: 663 - protein, 126 aa, Homo Sapien
QVQLQESGPGLVRPSGTLSLTCAVSGDSISSSNWWSWVRQPPGKGLEWIGEIYHSGNTNYNPSLKSRGTISVDKSKNQFSLKLTSITAADTAVYYCARARVYDILTGRGYYGMDVWGQGTTVTVSS

SEQ ID NO: 664 - DNA, 378 bp, Homo Sapien
caggtgcagctgcaggagtcgggcccaggactggtgaggccttcggggaccctgtccctcacctgcgctgtctctggtgactccatcagcagtagtaactggtggagttgggtccgccagcccccagggaaggggctggagtggattggggaaatctatcatagtgggaacaccaactacaatccgtccctcaagagtcgaggcaccatttcagtagacaagtccaagaaccagttctccctgaagctgacctctataaccgccgcggacacggccgtatattactgtgcgagagcgagggtttacgatattttgactggtcgaggttactacggtatggacgtctggggccaagggaccacggtcaccgtctcctca

SEQ ID NO: 665 - protein, 453 aa, Homo Sapien
QVQLQESGPGLVRPSGTLSLTCAVSGDSISSSNWWSWVRQPPGKGLEWIGEIYHSGNTNYNPSLKSRGTISVDKSKNQFSLKLTSITAADTAVYYCARARVYDILTGRGYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 666 - DNA, 1359 bp, Homo Sapien
caggtgcagctgcaggagtcgggcccaggactggtgaggccttcggggaccctgtccctcacctgcgctgtctctggtgactccatcagcagtagtaactggtggagttgggtccgccagcccccagggaaggggctggagtggattggggaaatctatcatagtgggaacaccaactacaatccgtccctcaagagtcgaggcaccatttcagtagacaagtccaagaaccagttctccctgaagctgacctctataaccgccgcggacacggccgtatattactgtgcgagagcgagggtttacgatattttgactggtcgaggttactacggtatggacgtctggggccaagggaccacggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 667 - protein, 6 aa, Homo Sapien
ALPKKY

SEQ ID NO: 668 - protein, 3 aa, Homo Sapien
EDR

SEQ ID NO: 669 - protein, 11 aa, Homo Sapien
FSTDSSGNPRV

SEQ ID NO: 670 - protein, 11 aa, Homo Sapien
SGDALPKKYAY

SEQ ID NO: 671 - protein, 7 aa, Homo Sapien
EDRKRPS

SEQ ID NO: 672 - protein, 11 aa, Homo Sapien
FSTDSSGNPRV

SEQ ID NO: 673 - protein, 108 aa, Homo Sapien
SYELTQPPSVSVSPGQTARITCSGDALPKKYAYWYQQKSGQAPVLVIHEDRKRPSGIPERFSGSSSGTMATLTISGAQVEDEADYYCFSTDSSGNPRVFGGGTKLTVL

SEQ ID NO: 674 - DNA, 324 bp, Homo Sapien
tcctatgagctgacacagccaccctcggtgtcagtgtccccaggacaaacggccaggatcacctgctctggagatgcattgccaaaaaagtatgcttattggtaccagcagaagtcaggccaggcccctgttctggtcatccatgaggacaggaaacgaccctccgggatccctgagagattctctggctccagctcagggacaatggccaccttgactatcagtggggcccaggtggaggatgaagctgactactactgtttctcaacagacagcagtggtaatcctagggtgttcggcggagggaccaagctgaccgtccta

SEQ ID NO: 675 - protein, 214 aa, Homo Sapien
SYELTQPPSVSVSPGQTARITCSGDALPKKYAYWYQQKSGQAPVLVIHEDRKRPSGIPERFSGSSSGTMATLTISGAQVEDEADYYCFSTDSSGNPRVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 676 - DNA, 651 bp, Homo Sapien
tctgaggcctcctatgagctgacacagccaccctcggtgtcagtgtccccaggacaaacggccaggatcacctgctctggagatgcattgccaaaaaagtatgcttattggtaccagcagaagtcaggccaggcccctgttctggtcatccatgaggacaggaaacgaccctccgggatccctgagagattctctggctccagctcagggacaatggccaccttgactatcagtggggcccaggtggaggatgaagctgactactactgtttctcaacagacagcagtggtaatcctagggtgttcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 677 - protein, 123 aa, Homo Sapien
EVQLVESGGGLVQPGRSLRLSCAASGFTFDDYAMHWVRLGPGRGLEWVSRISWNSGSTDYADSVKGRFTISRDNAKNSLFLQMNSLRTEDTALYYCAKERTPAGITVAGFDYWGQGSLVTVSS

SEQ ID NO: 678 - DNA, 369 bp, Homo Sapien
gaagtgcaactggtggagtctgggggaggcttggtacagcctggcaggtccctgagactctcctgtgcagcctctggattcacctttgatgattatgccatgcactgggtccggctaggtccagggaggggcctggagtgggtctcacgtattagttggaatagtggttccacagactatgcggactctgtgaagggccgattcaccatctccagagacaacgccaagaactccctctttctgcaaatgaacagtctgagaactgaggacacggccttgtattactgtgcaaaagaaagaacccccgcgggtataacagtggctggttttgactactggggccagggatccctggtcaccgtctcctca

SEQ ID NO: 679 - protein, 112 aa, Homo Sapien
DIVMTQSPLSLPVTPGEPASISCRSSQSLLHSNGFNYLDWYLQKPGQTPQLLIYLVSTRASGVPDRFSGSGSGTDFTLKISRVEAEDVGVFYCMQALQTPCSFGQGTKLEIK

SEQ ID NO: 680 - DNA, 336 bp, Homo Sapien
gatattgtgatgactcagtctccactctccctgcccgtcacccctggagagccggcctccatctcctgcaggtctagtcagagcctcctgcatagtaatggattcaactatttggattggtacctgcagaagccagggcagactccacaactcctgatctatttggtttctactcgggcctccggggtccctgacaggttcagtggcagtggatcaggcacagattttacactgaaaatcagcagagtggaggctgaggatgttggggttttttactgcatgcaagctctacaaactccgtgcagttttggccaggggaccaagctggagatcaaa

SEQ ID NO: 681 - protein, 123 aa, Homo Sapien
EVQLVESGGGLVQPGRSLRLSCAASGFTFDAYALHWVRLGPGRGLEWVSRISWNSGSIDYADSVKGRFTISRDNAKNSLYLQMNSLRTEDTALYYCAKERTPAGITVAGFDFWGQGTLVTVSS

SEQ ID NO: 682 - DNA, 369 bp, Homo Sapien
gaagtgcaactggtggagtctgggggaggcttggtacagcctggcaggtccctgagactctcctgtgcagcctctggattcacctttgatgcttatgccttgcactgggtccggctaggtccagggaggggcctggagtgggtctcacgtattagttggaatagtggttctattgactatgcggactctgtgaagggccgattcaccatctccagagacaacgccaagaactccctgtatctgcaaatgaacagtctgagaactgaggacacggccttgtattactgtgcaaaagaaagaacccccgcgggtataacagtggctggttttgacttctggggccaggggaccctggtcaccgtctcctca

SEQ ID NO: 683 - protein, 112 aa, Homo Sapien; identical to SEQ ID NO: 679

SEQ ID NO: 684 - DNA, 336 bp, Homo Sapien
gatattgtgatgactcagtctccactctccctgcccgtcacccctggagagccggcctccatctcctgcaggtctagtcagagcctcctgcatagtaatggattcaactatttggattggtacctgcagaagccaggacagactccacaactcctgatctatttggtttctactcgggcctccggggtccctgacaggttcagtggcagtggatcaggcacagattttacactgaaaatcagcagagtggaggctgaggatgttggggttttttactgcatgcaagctctacagactccgtgcagttttggccaggggaccaagctggagatcaaa

SEQ ID NO: 685 - protein, 123 aa, Homo Sapien
EVQLVESGGDLVQPGRSLRLSCAASGFTFDDYAMHWVRLGPGRGLEWVSRISWNSGSIDYADSVKGRFTISRDNAKNSLYLQMNSLRTEDTALYYCAKERTPAGITVAGFDYWGQGTLVTVSS

SEQ ID NO: 686 - DNA, 369 bp, Homo Sapien
gaagtgcagctggtggagtctgggggagacttggtacagcctggcaggtccctgagactctcctgtgcagcctctggattcacctttgatgattatgccatgcactgggtccggctaggtccagggaggggcctggagtgggtctcacgtattagttggaatagtggttctatagactatgcggactctgtgaagggccgattcaccatctccagagacaacgccaagaactccctgtatctgcaaatgaacagtctgagaactgaggacacggccttgtattactgtgcaaaagaaagaacccccgcgggtataacagtggctggttttgactactggggccagggaaccctggtcaccgtctcctca

SEQ ID NO: 687 - protein, 112 aa, Homo Sapien; identical to SEQ ID NO: 679

SEQ ID NO: 688 - DNA, 336 bp, Homo Sapien; identical to SEQ ID NO: 680

SEQ ID NO: 689 - protein, 123 aa, Homo Sapien
EVQLVESGGGLVQPGRSLRLSCAASGFTFDDYAMHWVRLGPGRGLEWVSRISWNSGSIDYADSVKGRFTISRDNAKNSLYLQMNSLRTEDTALYYCAKERTPAGITVAGFDYWGQGTLVTVSS

SEQ ID NO: 690 - DNA, 369 bp, Homo Sapien
gaagtgcagctggtggagtctgggggaggcttggtacagcctggcaggtccctgagactctcctgtgcagcctctggattcacgtttgatgattatgccatgcactgggtccggctaggtccagggaggggcctggagtgggtctcacgtattagttggaatagtggttctatagactatgcggactctgtgaagggccgattcaccatctccagagacaacgccaagaactccctgtatctgcaaatgaacagtctgagaactgaggacacggccctgtattactgtgcaaaagaaagaacccccgcgggtataacagtggctggttttgactactggggccagggaaccctggtcaccgtctcctca

SEQ ID NO: 691 - protein, 112 aa, Homo Sapien; identical to SEQ ID NO: 679

SEQ ID NO: 692 - DNA, 336 bp, Homo Sapien; identical to SEQ ID NO: 680

SEQ ID NO: 693 - protein, 121 aa, Homo Sapien
EVQLVESGGGLVKPGGSLRLSCAASGFTFSNAWMSWVRQAPGKGLEWVGRIKSKTNGGTTDYAAPVKGRFTISRDDSKNTLYLQMNSLKTEDTAVYCCTIDPLYDILTGPWGQGTLVTVSS

SEQ ID NO: 694 - DNA, 363 bp, Homo Sapien
gaggtgcagctggtggagtctgggggaggcttggtaaagcctggggggtcccttagactctcctgtgcagcctctggattcacttttagtaacgcctggatgagctgggtccgccaggctccagggaagggactggagtgggttggccgtattaaaagcaaaactaatggtgggacaacagactacgctgcacccgtgaaaggcagattcaccatctcaagagatgattcaaaaaacacgctgtatctgcaaatgaacagcctgaaaaccgaggacacagccgtttattgttgtaccatagaccccctctatgatattttgactggtccctggggccagggaaccctggtcaccgtctcctca

SEQ ID NO: 695 - protein, 106 aa, Homo Sapien
PYELTQAPSVSVSPGQAASITCSGDKLGDKYACWYQQKPGQSPVLVIYQDSKRPSGIPERFSGSNSGNTATLTISGTQAMDEADYYCQAWDSSTVVFGGGTKLTVL

SEQ ID NO: 696 - DNA, 318 bp, Homo Sapien
ccctatgaactgactcaggcaccctcagtgtccgtgtccccaggacaggcagccagcatcacctgctctggagataaattgggggataaatatgcttgctggtatcagcagaagccaggccagtcccctgtgctggtcatctatcaagatagcaagcggccctcagggatccctgagcgattctctggctccaattctgggaacacagccactctgaccatcagcgggacccaggctatggatgaggctgactattactgtcaggcgtgggacagcagcactgtggttttcggcggagggaccaagctgaccgtccta

SEQ ID NO: 697 - protein, 121 aa, Homo Sapien
EVQLVESGGGLVKPGGSLRLSCAASGFTFSYAWMSWVRQAPGKGLEWVGRIKSKTNGGTTDYAAPVKGRFTISRDDSKDTLYLLMNSLKTEDTAVYYCTIDPLYDLLTGPWGQGTLVTVSS

SEQ ID NO: 698 - DNA, 363 bp, Homo Sapien
gaggtgcagctggtggagtctgggggaggcttggtaaagcctggggggtcccttagactctcctgtgcagcctctggattcacttttagttacgcctggatgagctgggtccgccaggctccagggaaggggctggagtgggttggccgtattaaaagcaaaactaatggtgggacaacagactacgctgcacccgtgaaaggcagattcaccatctcaagagatgattcaaaagacacgctgtatctgctaatgaacagcctgaaaaccgaggacacagccgtgtattactgtaccatagaccccctctacgatcttttgactggtccctggggccagggaaccctggtcaccgtctcctca

SEQ ID NO: 699 - protein, 106 aa, Homo Sapien
SYELTQPPSVSVSPGQTASITCSGDKLGDKYGCWYQQKPGQSPILVIYQDSKRPSGIPERFSGSNSGNTATLTISGTQAMDEADYYCQAWDSSTVVFGGGTKLTVL

SEQ ID NO: 700 - DNA, 318 bp, Homo Sapien
tcctatgagctgactcagccaccctcagtgtccgtgtccccaggacagacagccagcatcacctgctctggagataaattgggggataaatatggttgctggtatcagcagaagccaggccagtcccctatactggtcatctatcaagatagcaagcggccctcggggatccctgagcgattctctggctccaattctgggaacacagccactctgaccatcagcgggacccaggctatggatgaggctgactattactgtcaggcgtgggacagcagcactgtggtattcggcggagggaccaagctgaccgtccta

SEQ ID NO: 701 - protein, 121 aa, Homo Sapien
EVQLVESGGGLVKPGGSLRLSCAASGFTFSNAWMSWVRQAPGKGLEWVGRIKSKTNGGTTDYAAPVKGRFTISRDDSKNTLYLQMNSLKTEDTAVYYCTIDPLYDILTGPWGQGTLVTVSS

SEQ ID NO: 702 - DNA, 363 bp, Homo Sapien
gaggtgcagctggtggagtctgggggaggcttggtaaagcctggggggtcccttagactctcctgtgcagcctctggattcacttttagtaacgcctggatgagctgggtccgccaggctccagggaaggggctggagtgggttggccgtattaaaagcaaaactaatggtgggacaacagactacgctgcacccgtgaaaggcagattcaccatctcaagagatgattcaaaaaacacgctgtatctgcaaatgaacagcctgaaaaccgaggacacagccgtgtattactgtaccatagaccccctctacgatattttgactggtccctggggccagggaaccctggtcaccgtctcctca

SEQ ID NO: 703 - protein, 106 aa, Homo Sapien
SYELTQPPSVSVSPGQTASITCSGDKLGDKYACWYQQKPGQSPVLVIYQDSKRPSGIPERFSGSNSGNTATLTISGTQAMDEADYYCQAWDSSTVVFGGGTKLTVL

SEQ ID NO: 704 - DNA, 318 bp, Homo Sapien
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaattctgggaacacagccactctgaccatcagcgggacccaggctatggatgaggctgactattactgtcaggcgtgggacagcagcactgtggtattcggcggagggaccaagctgaccgtccta

SEQ ID NO: 705 - protein, 121 aa, Homo Sapien
EVQLVESGGGLVKPGGSLRLSCAASGFTFSYAWMSWVRQAPGKGLEWVGRIKSKTNGGTTDYAAPVKGRFTISRDDSKNTLYLQMNSLKTEDTAVYYCTTDPLYDILTGLWGQGTLVTVSS

SEQ ID NO: 706 - DNA, 363 bp, Homo Sapien
gaggtgcagctggtggagtctgggggaggcttggtaaagcctggggggtcccttagactctcctgtgcagcctctggattcactttcagttacgcctggatgagctgggtccgccaggctccagggaaggggctggagtgggttggccgtatcaaaagcaaaactaatggtgggacaacagactacgctgcacccgtgaaaggcagattcaccatctcaagagatgattcaaaaaacacgctgtatctgcaaatgaacagcctgaaaaccgaggacacagccgtgtattactgtaccacagaccccctctacgatattttgactggtctatggggccagggaaccctggtcaccgtctcctca

SEQ ID NO: 707 - protein, 106 aa, Homo Sapien
SYELTQPPSMSVSPGQTASITCSGDKLGDKYACWYQQKPGQSPVLVIYQDSKRPSGIPERFSGSNSGNTATLTISGTQAMDESDYYCQAWDSSTVVFGGGTKLTVL

SEQ ID NO: 708 - DNA, 318 bp, Homo Sapien
tcctatgaactgactcagccaccctcaatgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgagtctgactattactgtcaggcgtgggacagcagcactgtggtattcggcggagggaccaaactgaccgtccta

SEQ ID NO: 709 - protein, 121 aa, Homo Sapien; identical to SEQ ID NO: 623

SEQ ID NO: 710 - DNA, 363 bp, Homo Sapien; identical to SEQ ID NO: 624

SEQ ID NO: 711 - protein, 107 aa, Homo Sapien
DIQMTQSPSSLSASVGDRVTITCRASQNIKSYLTWYQQKPGKAPKLLIYTASSLQSGVPSRFSGSGSGTDFTLTISSLQPEDFATYYCQQSYSIPCSFGQGTKLEIK

SEQ ID NO: 712 - DNA, 321 bp, Homo Sapien
gacatccagatgacccagtctccatcctccctgtctgcatctgtaggagacagagtcaccatcacttgccgggcaagtcagaacattaagagttatttaacttggtatcagcagaaaccagggaaagcccctaagctcctgatctatactgcatccagtttacaaagtggggtcccatcaaggttcagtggcagtggatctgggacagatttcactctcaccatcagcagtctgcaacctgaagattttgcaacttattactgtcaacagagttacagtatcccgtgcagttttggccaggggaccaagctggagatcaaa

SEQ ID NO: 713 - protein, 122 aa, Homo Sapien
EVQLEESGGGLVKPGGSLRLSCAASGFTFSNAWMSWVRQAPGKGLEWVGRIKSKTNGGTRDYAAPVKGRFTISRDDSKNTLYLQMNSLKTEDTAVYYCTTDPPLYDLLTGHWGQGTLVTVSS

SEQ ID NO: 714 - DNA, 366 bp, Homo Sapien
gaggtgcagctggaggagtctgggggaggcttggtaaagccgggggggtcccttagactctcctgtgcagcctctggattcactttcagtaacgcctggatgagctgggtccgccaggctccagggaaggggctggagtgggttggccgtattaaaagcaaaactaatggtgggacaagagactatgctgcacccgtgaaaggcagattcaccatctcaagagatgattcaaaaaacacgctgtatctgcaaatgaacagcctgaaaaccgaggacacagccgtgtattactgtaccacagatccccccctttacgatcttttgactggccattggggccagggaaccctggtcaccgtctcctca

SEQ ID NO: 715 - protein, 106 aa, Homo Sapien
SYELTQPPSVSVSPGQTASITCSGDKLGDKYACWYQQKPGQSPVLVIYQDSKRPSGIPERFSGSNSGNTATLTISGTQAMDEADYYCQAWDSNTAVFGAGTKVTVL

SEQ ID NO: 716 - DNA, 318 bp, Homo Sapien
tcctatgaactgactcagccaccctcagtgtccgtgtccccaggacagacagccagcatcacctgctctggagataaattgggggataaatatgcttgctggtatcagcagaagccaggccagtcccctgtgctggtcatctatcaagatagtaagcggccctcagggatccctgagcgattctctggctccaactctgggaacacagccactctgaccatcagcgggacccaggctatggatgaggctgactattactgtcaggcctgggacagcaacactgctgtcttcggagctgggaccaaggtcaccgtccta

SEQ ID NO: 717 - protein, 122 aa, Homo Sapien
EVQLVESGGGLVKPGGSLRLSCAASGFTFSNVWMSWVRQAPGKGLEWVGRIKSKSNGGTTDNSAPVKGRFTISRDDSKNTLYLQMNSLKTEDTAVYYCTTDPPLYDILTGHWGQGTLVIVSS

SEQ ID NO: 718 - DNA, 366 bp, Homo Sapien
gaggtgcagctggtggagtctgggggaggcttggtaaagcctggggggtcccttagactctcctgtgcagcctctggattcactttcagtaacgtctggatgagctgggtccgccaggctccagggaaggggctggagtgggttggccgtattaaaagtaaaagtaatggtgggacaacagacaactctgcacccgtgaaaggcagattcaccatttcaagagatgattcaaaaaacacgctgtatctgcaaatgaacagcctgaaaaccgaggacacagccgtgtattactgtaccacagatccccccctttacgatattttgactggccattggggccagggaaccctggtcattgtctcctca

SEQ ID NO: 719 - protein, 106 aa, Homo Sapien
SYELTQPPSVSVSPGQTASITCSGDKLGDKYACWYQQKPGQSPVLVIYQDNKRPSGIPERFSGSNSGNTATLTISGTQAMDEADYYCQAWDSSTAVFGTGTKVTVL

SEQ ID NO: 720 - DNA, 318 bp, Homo Sapien
tcctatgaattgactcagccaccctcagtgtccgtgtccccaggacagacagccagcatcacctgctctggagataaattgggggataaatatgcttgctggtatcagcagaagccaggccagtcccctgtgctggtcatctatcaggataacaagcggccctcagggatccctgagcgattctctggctccaactctgggaacacagccactctgaccatcagcgggacccaggctatggatgaggctgactattactgtcaggcgtgggacagcagcactgctgtcttcggaactgggaccaaggtcaccgtccta

SEQ ID NO: 721 - protein, 121 aa, Homo Sapien
EVQLVESGGGLVQPGRSLRLSCAASGFTFDDYAMHWVRQTPGKGLEWVSGISWNSITIGYADSVKGRFTLSRDNAKNSLYLQMNSLIAEDTALYYCAKDGGSLRYYGMDVWGQGTTVTVSS

SEQ ID NO: 722 - DNA, 363 bp, Homo Sapien
gaagtgcagttggtggagtctgggggaggcttggtacagcctggcaggtccctgagactctcctgtgcagcctctggattcacctttgatgattatgccatgcactgggtccggcaaactccagggaagggcctggagtgggtctcaggtattagttggaatagtatcaccataggctatgcggactctgtgaagggccgattcaccctgtccagagacaacgccaagaactccctgtatctgcaaatgaacagtctgatagctgaggacacggccttgtattactgtgcaaaagatggtggttcacttcgctactacggtatggacgtctggggccaagggaccacggtcaccgtctcctca

SEQ ID NO: 723 - protein, 112 aa, Homo Sapien
DIVMTQSPLSLPVTPGEPASISCRSSQSLLHSNGYNYLNWYLQKAGQSPQLLIYLGSNRASGVPDRFSGSGSGTDFTLKISRVEAEDVGVFYCMQALQTPLTFGGGTKVEIK

SEQ ID NO: 724 - DNA, 336 bp, Homo Sapien
gatattgtgatgactcagtctccactctccctgcccgtcacccctggagagccggcctccatctcctgcaggtctagtcagagcctcctgcatagtaatggatacaactatttgaattggtacctgcagaaggcagggcagtctccacagctcctgatctatttgggttctaatcgggcctccggggtccctgacaggttcagtggcagtggatcaggcacagattttacactgaaaatcagcagagtggaggctgaggatgttggggttttttactgcatgcaagctctacaaactccgctcactttcggcggagggactaaggtggagatcaaa

SEQ ID NO: 725 - protein, 121 aa, Homo Sapien
EVQLVESGGGLVQPGRSLRLSCTASGFSFDDYAMHWVRQVPGKGLEWVSGISWNSITIGYADSVKGRFTISRDNAKNSLYLQMNSLRAEDTALYFCAKDGGNRKYYGMDVWGQGTTVTVSS

SEQ ID NO: 726 - DNA, 363 bp, Homo Sapien
gaagtgcagctggtggagtctgggggaggcttggtccagcctggcaggtccctgagactctcctgtacagcctctggattctcctttgatgattatgccatgcactgggtccggcaagttccagggaagggcctggagtgggtctcaggtattagttggaatagtattaccattggctatgcggactctgtgaagggccgattcaccatctccagagacaacgccaagaactccctctatctgcaaatgaacagtctgagagctgaggacacggccttgtatttctgtgcaaaagatggggggaataggaaatactatggtatggacgtctggggccaagggaccacggtcaccgtctcctca

SEQ ID NO: 727 - protein, 112 aa, Homo Sapien
DIVMTQSPLSLPVTPGEPASISCRSSQSLLHSNGYNYLDWYLQKPGQSPHLLIYLGSNRASGVPDRFSGSGSGTDFTLKISRVEADDVGVYFCLQALQTPCSFGQGTKLEIK

SEQ ID NO: 728 - DNA, 336 bp, Homo Sapien
gatattgtgatgactcagtctccactctccctgcccgtcacccctggagagccggcctccatctcctgcaggtctagtcagagcctcctgcatagtaatggatacaactatttggattggtacctgcagaagccagggcagtctccacacctcctgatctatttgggttctaatcgggcctccggggtccctgacaggttcagtggcagtggatcaggcacagattttacactgaaaatcagcagagtggaggctgacgatgttggggtttatttctgcttgcaagctctacaaactccgtgcagttttggccaggggaccaagctggagatcaaa

SEQ ID NO: 729 - protein, 121 aa, Homo Sapien
EVQLVESGGGLVQPGRSLRLSCAASGFTFDDYAMHWVRQAPGKGLEWVSGISWNSITIGYADSVKGRFTISRDNAKNSLYLQMNSLRAEDTALYYCTKDGGNRRYYGVDVWGQGTTVTVSS

SEQ ID NO: 730 - DNA, 363 bp, Homo Sapien
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtattaccataggctatgcggactctgtgaagggccgattcaccatctccagagacaacgccaagaactccctctatctgcaaatgaacagtctgagagctgaggacacggccttgtattactgtacaaaagatggggggaataggagatactacggtgtggacgtctggggccaagggaccacggtcacagtctcctca

SEQ ID NO: 731 - protein, 112 aa, Homo Sapien
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPCSFGQGTKLEIK

SEQ ID NO: 732 - DNA, 336 bp, Homo Sapien
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccgtgcagttttggccaggggaccaagctggagatcaaa

SEQ ID NO: 733 - protein, 121 aa, Homo Sapien
EVQLVESGGGLVQPGRSLRLSCAASGFTFDDYAMHWVRQAPGKGLEWVSGISWNSINIGYADSVKGRFTISRDNAKNSLYLQMNSLRAEDTALYYCAKDIPVKSYNGLDVWGQGTTVTVSS

SEQ ID NO: 734 - DNA, 363 bp, Homo Sapien
gaagtgcagctggtggagtctgggggaggcttggtacagcctggcaggtccctgagactctcctgtgcagcctctggattcacctttgacgattatgccatgcactgggtccggcaagctccagggaagggcctggagtgggtctcaggtattagctggaatagtattaacataggctatgcggactctgtgaagggccgattcaccatctccagagacaacgccaagaactccctgtatctgcaaatgaacagtctgagagctgaggacacggccttgtattactgtgcaaaagacatcccggtgaagtcctacaacggtttggacgtctggggccaagggaccacggtcaccgtctcctca

SEQ ID NO: 735 - protein, 112 aa, Homo Sapien
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVEIK

SEQ ID NO: 736 - DNA, 336 bp, Homo Sapien
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccgctcactttcggcggagggaccaaggtggagatcaaa

SEQ ID NO: 737 - protein, 121 aa, Homo Sapien
EVQLVESGGGLVQPGGSLRLSCAASGFTFDDYGMYWVRQVPGKGLEWVSGISWNSISIGYADSVKGRFTISRDNAKNSLYLDMNTLRAEDTAMYYCAKDGGLKYYYGMDVWGQGTTVTVSS

SEQ ID NO: 738 - DNA, 363 bp, Homo Sapien
gaagtgcagttggtggagtctgggggaggcttggtacagcctggcgggtccctgagactctcctgtgcagcctctggattcacctttgacgattatggcatgtactgggtccggcaagttccagggaagggcctggagtgggtctcaggaattagttggaatagtattagtataggctatgcggactctgtgaagggccgattcaccatctccagagacaacgccaagaattccctgtatctggacatgaacacactgagagctgaggacacggccatgtattactgtgcaaaagatggtggcttgaaatactactacggtatggacgtctggggccaagggaccacggtcaccgtctcctca

SEQ ID NO: 739 - protein, 112 aa, Homo Sapien
DIVMTQSPLSLPVTPGEPASISCRSSQSLLHSNGYIYLAWYLHKPGQSPHLLIYLGSNRASGVPDRFSGSGSSTDFTLKISRVESEDVGIYYCMQALQTPLTFGGGTKVEIK

SEQ ID NO: 740 - DNA, 336 bp, Homo Sapien
gatattgtgatgactcagtctccactctccctgcccgtcacccctggagagccggcctccatctcctgcaggtctagtcagagcctcctgcatagtaatggatacatctatctggcttggtacctgcataagccaggacagtctccacatctcctgatctatttgggttctaatcgggcctccggggtccctgacaggttcagtggcagtggatcaagcacagattttacactgaaaatcagcagagtggagtctgaggatgttgggatttattactgcatgcaagctctacaaactccgctcactttcggcggagggaccaaggtggagatcaaa

SEQ ID NO: 741 - protein, 121 aa, Homo Sapien
QVQLVESGGGLVKPGGSLRLSCAASGFIFSDYYMSWIRQAPGKGLEWISYSSSSGPTIYFADSVKGRFTISRDNAKKSLYLQMNSLRDEDTAVYYCAREGITMGRWGMDVWGQGTMVTVSS

SEQ ID NO: 742 - DNA, 363 bp, Homo Sapien
caggtgcagttggtggagtctgggggaggcttggtcaagcctggagggtccctgagactctcctgtgcagcctctggattcatcttcagtgactactacatgagttggatccgccaggctccagggaaggggctggagtggatttcatatagtagtagtagtggtcctaccatatacttcgcagactctgtgaagggccgattcaccatctccagggacaatgccaagaagtcattgtatctgcaaatgaacagcctgagagacgaggacacggccgtatattattgtgcgagagagggtatcactatgggccggtggggtatggacgtctggggccaagggaccatggtcaccgtctcatca

SEQ ID NO: 743 - protein, 105 aa, Homo Sapien
DMQMTQSPSTLSASVGDRVTITCRASQSISNWLAWYQQKPGKAPKLLIYKASNLESGVSSRFSGSGSGTEFTLTISSLQPDDVATYHCQQYNSYTFGGGTKVEIK

SEQ ID NO: 744 - DNA, 315 bp, Homo Sapien
gacatgcagatgacccagtctccttccaccctgtctgcatctgtaggagacagagtcaccatcacttgccgggccagtcagagtatcagtaactggttggcctggtatcagcagaaaccagggaaagcccctaaactcctgatctataaggcgtctaatttagaaagtggggtctcatcaaggttcagcggcagtggatctgggacagaattcactctcaccatcagcagcctgcagcctgatgatgttgcaacttatcactgccaacagtataatagttatactttcggcggagggaccaaggtggagatcaaa

SEQ ID NO: 745 - protein, 120 aa, Homo Sapien
EVQLVESGGSVVRPGGSLRLSCAASGFSFDASGMSWIRQAPGKGLEWVSGINYIGGSTGYADSVKGRFTISRDNAKNSLYLQMNSLRADDTALYYCAREVYSSTWYDDYWGQGTLVTVSS

SEQ ID NO: 746 - DNA, 360 bp, Homo Sapien
gaggtgcagctggtggagtctgggggaagtgttgtacggccgggggggtccctgagactctcctgtgcagcctctggattctcctttgatgcttctggcatgagctggatccgccaagctccagggaagggcctggagtgggtctctggtattaattacattggtggtagcacaggttatgcagactctgtgaagggccgattcaccatctccagagacaacgccaagaactccctgtatctccaaatgaacagtctgagagccgacgacacggccttgtattactgtgcgcgagaggtttatagcagcacctggtacgatgactactggggccagggaaccctggtcaccgtctcctca

SEQ ID NO: 747 - protein, 107 aa, Homo Sapien
DIQMTQSPSSLSTSVGDRVTITCRASQSINTYLNWYQQKSGKAPKLLIYAASSLRSGVPSRFSGSGSGTDFTLTINNLQPEDFATYYCQQSYRTPLTFGGGAKVEIK

SEQ ID NO: 748 - DNA, 321 bp, Homo Sapien
gacatccagatgacccagtctccttcctccctgtctacatctgtaggagacagagtcaccatcacttgccgggcaagtcagagcattaacacctatttaaattggtatcagcagaaatcagggaaagcccctaaactcctgatctatgctgcatccagtttgcgaagtggggttccatcaaggttcagtggcagtggatcggggacagatttcactctcaccatcaacaatctacaacctgaagattttgcaacttactactgtcaacagagttacaggaccccgctcactttcggcggaggggccaaggtggagatcaaa

SEQ ID NO: 749 - protein, 121 aa, Homo Sapien
EVQLVESGGGLVQPGRSLRLSCAASGFTFDDYAMHWVRQVPGKGLEWVSGISWNSITIGYAGSVKGRFTISRDNAKNSLYLQMNSLRVEDTALYYCSKDIGVMKYFGLDVWGQGTMVTVSS

SEQ ID NO: 750 - DNA, 363 bp, Homo Sapien
gaagtgcaactggtggagtctgggggaggcttggtacagcctggcaggtccctgagactctcctgtgcagcctctggattcacctttgatgattatgccatgcactgggtccggcaagttccagggaagggcctggagtgggtctcaggtattagttggaatagtattaccataggctatgcgggctctgtgaagggccgattcaccatctccagagacaacgccaaaaactccctgtatctacaaatgaacagtctgagagttgaggacacggccttatattactgttcaaaagatataggagtcatgaagtacttcggtttggacgtctggggccaagggaccatggtcaccgtctcctca

SEQ ID NO: 751 - protein, 112 aa, Homo Sapien
DIVMTQSPLSLPVTPGEPASISCRSSQSLLHSNGYNYLDWYLQKPGQSPQLLIHLGSIRASGVPDRFSGSGSGTDFTLKISRVEAEDVGVYNCMQALQTPLTFGGGTKVEIK

SEQ ID NO: 752 - DNA, 336 bp, Homo Sapien
gatattgtgatgactcagtctccgctctccctgcccgtcacccctggagagccggcctccatctcctgcaggtctagtcagagcctcctgcatagtaatggatacaactatttggattggtacctgcagaagccagggcagtctccacaactcctgatccatctgggttctattcgggcctccggggtccctgacaggttcagtggcagtggatcaggcacagattttacactgaaaatcagtagagtggaggctgaggatgttggggtttataactgcatgcaagctctacaaactccgctcactttcggcggagggaccaaggtggagatcaaa

SEQ ID NO: 753 - protein, 11 aa, Artificial Sequence
  CDRH3
  misc_feature (1)..(1): Xaa can be any naturally occurring amino acid
  misc_feature (5)..(5): Xaa can be any naturally occurring amino acid
  misc_feature (8)..(8): Xaa can be any naturally occurring amino acid
  Xaa (9)..(9): May be either present or absent
  Xaa (9)..(9): If present may be any naturally occurring amino acid
XGSGXYGXXFD

The invention claimed is:

1. An antibody or fragment that comprises one or more TIGIT binding sites, wherein each binding site specifically binds to TIGIT and comprises a heavy chain variable ($V_H$) domain and a light chain variable ($V_L$) domain; wherein:
   (a) the $V_H$ domain comprises an amino acid sequence at least 85% identical to SEQ ID NO:603 and the $V_L$ domain comprises an amino acid sequence at least 85% identical to SEQ ID NO:613;
   (b) the $V_H$ domain comprises an amino acid sequence at least 85% identical to SEQ ID NO:623 and the $V_L$ domain comprises an amino acid sequence at least 85% identical to SEQ ID NO:633;
   (c) the $V_H$ domain comprises an amino acid sequence at least 85% identical to SEQ ID NO:643 and the $V_L$ domain comprises an amino acid sequence at least 85% identical to SEQ ID NO:653; or
   (d) the $V_H$ domain comprises an amino acid sequence at least 85% identical to SEQ ID NO:663 and the $V_L$ domain comprises an amino acid sequence at least 85% identical to SEQ ID NO:673; and
wherein:
   (i) the $V_H$ domain of the antibody or fragment comprises the CDRH3 sequence of SEQ ID NO:599 or 602, the CDRH2 sequence of SEQ ID NO:598 or 601, and the CDRH1 sequence of SEQ ID NO:597 or 600; and the $V_L$ domain of the antibody or fragment comprises the CDRL3 sequence of SEQ ID NO:609 or 612, the CDRL2 sequence of SEQ ID NO:608 or 611, and the CDRL1 sequence of SEQ ID NO:607 or 610;
   (ii) the $V_H$ domain of the antibody or fragment comprises the CDRH3 sequence of SEQ ID NO:619 or 622, the CDRH2 sequence of SEQ ID NO:618 or 621, and the CDRH1 sequence of SEQ ID NO:617 or 620; and the $V_L$ domain of the antibody or fragment comprises the CDRL3 sequence of SEQ ID NO:629 or 632, the CDRL2 sequence of SEQ ID NO:628 or 631, and the CDRL1 sequence of SEQ ID NO:627 or 630;
   (iii) the $V_H$ domain of the antibody or fragment comprises the CDRH3 sequence of SEQ ID NO:639 or 642, the CDRH2 sequence of SEQ ID NO:638 or 641, and the CDRH1 sequence of SEQ ID NO:637 or 640; and the $V_L$ domain of the antibody or fragment comprises the CDRL3 sequence of SEQ ID NO:649 or 652, the CDRL2 sequence of SEQ ID NO:648 or 651, and the CDRL1 sequence of SEQ ID NO:647 or 650; or
   (iv) the $V_H$ domain of the antibody or fragment comprises the CDRH3 sequence of SEQ ID NO:659 or 662, the CDRH2 sequence of SEQ ID NO:658 or 661, and the CDRH1 sequence of SEQ ID NO:657 or 660; and the $V_L$ domain of the antibody or fragment comprises the CDRL3 sequence of SEQ ID NO:669 or 672, the CDRL2 sequence of SEQ ID NO:668 or 671, and the CDRL1 sequence of SEQ ID NO:667 or 670.

2. The antibody or fragment of claim 1, comprising first and second copies of said $V_H$ domain and/or said $V_L$ domain.

3. The antibody or fragment of claim 1, wherein the $V_H$ domain further comprises a heavy chain constant region, wherein the heavy chain constant region comprises a human IgG1 or IgG4 constant region; and wherein the $V_L$ domain further comprises a light chain constant region, wherein the light chain constant region comprises a human kappa or lambda constant region.

4. The antibody or fragment of claim 1, wherein
   (i) the $V_H$ domain is encoded by a nucleotide sequence that is derived from the recombination of a human $V_H$ gene segment, $D_H$ gene segment and $J_H$ gene segment, wherein the $V_H$ gene segment is selected from IGHV3-11, IGHV3-15, IGHV3-20, IGHV3-9, and IGHV4-4; and
   (ii) the $V_L$ domain is encoded by a nucleotide sequence that is derived from the recombination of a human $V_L$ gene segment and $J_L$ gene segment, wherein the $V_L$ gene segment is selected from IGKV1-39, IGKV1D-39, IGKV1-5, IGLV3-1, IGKV2-28, and IGLV3-10.

5. The antibody or fragment according to claim 4, wherein the $D_H$ gene segment is a human gene segment selected from IGHD3-10, IGHD3-9, IGHD6-13, IGHD6-19, IGHD1-14, IGHD2-21, IGHD4-17, and IGHD4-23 and/or the $J_H$ gene segment is a human gene segment selected from IGHJ4, IGHJ5, and IGHJ6.

6. The antibody or fragment according to claim 4, wherein the $V_L$ domain is a $V_\kappa$ and the $J_L$ gene segment is a human gene segment selected from IGKJ2*04 and IGKJ4*01; or the $V_L$ domain is a $V_\lambda$ and the $J_L$ gene segment is a human gene segment selected from IGLJ1*01, IGLJ2*01, and IGLJ3*02.

7. The antibody or fragment of claim 1, which specifically binds to a human TIGIT comprising SEQ ID NO:540 or 544, a cynomolgus TIGIT comprising SEQ ID NO:547 or 549, and/or a mouse TIGIT comprising SEQ ID NO:556 or 559.

8. A nucleic acid that encodes a $V_H$ domain and/or a $V_L$ domain of the antibody or fragment of claim 1.

9. A vector comprising the nucleic acid of claim 8.

10. An isolated host cell comprising the vector of claim 9.

11. A pharmaceutical composition comprising the antibody or fragment of claim 1 and a pharmaceutically acceptable excipient, diluent, or carrier.

12. The pharmaceutical composition of claim 11, in combination with a further therapeutic agent.

13. A method of inhibiting TIGIT-mediated suppression of T-cells and/or NK cells that express TIGIT in a subject, comprising administering an effective amount of the antibody or fragment of claim 1.

14. A method of increasing T- and/or NK cell proliferation, cytokine production by T- and/or NK cells, or degranulation of tumour antigen-specific CD8+ T cells and/or TIL CD8+ T cells in a subject, comprising administering an effective amount of the antibody or fragment of claim 1.

* * * * *